(12) United States Patent
Isogai et al.

(10) Patent No.: US 6,979,557 B2
(45) Date of Patent: Dec. 27, 2005

(54) FULL-LENGTH CDNA

(75) Inventors: Takao Isogai, Ibaraki (JP); Tomoyasu Sugiyama, Tokyo (JP); Tetsuji Otsuki, Chiba (JP); Ai Wakamatsu, Chiba (JP); Hiroyuki Sato, Osaka (JP); Shizuko Ishii, Chiba (JP); Jun-ichi Yamamoto, Chiba (JP); Yuuko Isono, Chiba (JP); Yuri Hio, Chiba (JP); Kaoru Otsuka, Saitama (JP); Keiichi Nagai, Tokyo (JP); Ryotaro Irie, Chiba (JP); Ichiro Tamechika, Osaka (JP); Naohiko Seki, Chiba (JP); Tsutomu Yoshikawa, Chiba (JP); Motoyuki Otsuka, Tokyo (JP); Kenji Nagahari, Tokyo (JP); Yasuhiko Masuho, Tokyo (JP)

(73) Assignee: Research Association for Biotechnology, Tokyo (JP)

( * ) Notice: Subject to any disclaimer, the term of this patent is extended or adjusted under 35 U.S.C. 154(b) by 56 days.

(21) Appl. No.: 10/094,749

(22) Filed: Mar. 12, 2002

(65) Prior Publication Data

US 2003/0219741 A1 Nov. 27, 2003

Related U.S. Application Data

(60) Provisional application No. 60/350,435, filed on Jan. 24, 2002.

(30) Foreign Application Priority Data

Sep. 14, 2001 (JP) ...................................... 2001-328381

(51) Int. Cl.$^7$ ............................................... C12P 21/02
(52) U.S. Cl. ................ 435/69.1; 435/320.1; 435/252.3; 435/325; 435/91.1; 536/23.5; 536/23.1; 536/24.31
(58) Field of Search ............................. 536/23.1, 23.5, 536/24.31; 435/320.1, 325, 252.3, 69.1, 91.1, 91.2, 6

(56) References Cited

FOREIGN PATENT DOCUMENTS

| EP | 1026242 A1 | 9/2000 |
|---|---|---|
| EP | 1 067 182 A | 1/2001 |
| WO | WO 00/011015 A | 3/2000 |
| WO | WO 01/07607 A | 2/2001 |

OTHER PUBLICATIONS

Bourne (in Structural Bioinformatics, 2003, Bourne et al (eds.), Wiley–Liss, Inc., pp. 499–505).*
GenBank Accession No. AL158167 (Dec. 22, 2000).*
"Homo sapiens cDNA clone Image: 5088046", NCI–MGC (http://mgc.nci.nih.gov/;), Jul. 18, 2001, Database accession No. B1261842 XP002258422.
T. Ota et al., "Human cDNA encoding a membrane or secretory protein clone PSEC0214", May 23, 2001, Database accession No. AAF93862 XP002258423.
T. Ota et al., "Human membrane or secretory protein clone PSEC0110", May 23, 2001, Database accession No. AAB88374 XP002258424.
D. Valenzuela et al., "cDNA encoding human secreted protein vc40_1, Seq ID No.:29." Jun. 19, 2000, Database accession No. AAA23437 XP002258425.
D. Valenzuela et al., "Human secreted protein vc40_1, Seq ID No.:30," Jun.19, 2000, Database accession No. AAY94995 XP002258426.
Henrik T. Yudate et al., "Hunt: launch of a full–length cDNA database from the Helix Research Institute", Nucleic Acids Research, 2001, pp. 185–188, vol. 29–No. 1.
S. Sugano et al., Tanpakushitsu Kakusan Koso (Protein, Nucleic Acid and Enzyme), vol. 38, No. 3, pp. 476–481 English language abstract attached.
Homology Search Result Data (hemology search result of the clones disclosed in present application) pp. 1–53, Jun. 22, 2001.
P. Wong, et al., "Identification and Partial Characterization of a Candidate Gene for X–ILinked Retinopathies Using a Lateral Approach", Genomics, 1993, pp. 467–441, vol. 15.

* cited by examiner

*Primary Examiner*—James Martinell
(74) *Attorney, Agent, or Firm*—Foley & Lardner LLP

(57) ABSTRACT

Novel full-length cDNAs are provided.

1639 cDNA derived from human have been isolated. The full-length nucleotide sequences of the cDNA and amino acid sequences encoded by the nucleotide sequences have been determined. Because the cDNA of the present invention are full-length and contain the translation start site, they provide information useful for analyzing the functions of the polypeptide.

7 Claims, 1 Drawing Sheet

FULL-LENGTH CDNA

This application claims the benefit of priority of Japanese Application No. 2001-328381 filed Sep. 14, 2001, and U.S. Provisional Application No. 60/350,435 filed Jan. 24, 2002, the respective disclosures of which Japanese application and U.S. provisional application are hereby incorporated by reference herein.

FIELD OF THE INVENTION

The present invention relates to polynucleotides encoding novel polypeptides, polypeptides encoded by the polynucleotides, and new uses of these.

BACKGROUND OF THE INVENTION

Currently, the sequencing projects, the determination and analysis of the genomic DNA of various living organisms have been in progress all over the world. The whole genomic sequences of more than 40 species of prokaryotes, a lower eukaryote, yeast, a multicellular eukaryote, C. elegans, and a higher plants, arabidopsis, etc. are already determined. For human genome, presumably having 3 billion base pairs, the analysis was advanced under global cooperative organization, and a draft sequence was disclosed in 2001. Moreover, all the structures are to be clear and to be disclosed in 2002–2003. The aim of the determination of genomic sequence is to reveal the functions of all genes and their regulation and to understand living organisms as a network of interactions between genes, proteins, cells or individuals through deducing the information in a genome, which is a blueprint of the highly complicated living organisms. To understand living organisms by utilizing the genomic information from various species is not only important as an academic subject, but also socially significant from the viewpoint of industrial application.

However, determination of genomic sequences itself cannot identify the functions of all genes. For example, as for yeast, only the function of approximately half of the 6000 genes, which is predicted based on the genomic sequence, was able to be deduced. On the other hand, the human genome has been estimated to contain about 30,000–40,000 genes. Further, 100,000 or more types of mRNAs are said to exist when variants produced by alternative splicing are taken into consideration. Therefore, it is desirable to establish "a high throughput analysis system of the gene functions" which allows us to identify rapidly and efficiently the functions of vast amounts of the genes obtained by the genomic sequencing.

Many genes in the eukaryotic genome are split by introns into multiple exons. Thus, it is difficult to predict correctly the structure of encoded protein solely based on genomic information. In contrast, cDNA, which is produced from mRNA that lacks introns, encodes a protein as a single continuous amino acid sequence and allows us to identify the primary structure of the protein easily. In human cDNA research, to date, more than three million ESTs (Expression Sequence Tags) are publicly available, and the ESTs presumably cover not less than 80% of all human genes.

The information of ESTs is utilized for analyzing the structure of human genome, or for predicting the exon-regions of genomic sequences or their expression profile. However, many human ESTs have been derived from proximal regions to the 3'-end of cDNA, and information around the 5'-end of mRNA is extremely little. Among human cDNAs, the number of the corresponding mRNAs whose encoding full-length protein sequences are deduced is approximately 13,000.

It is possible to identify the transcription start site of mRNA on the genomic sequence based on the 5'-end sequence of a full-length cDNA, and to analyze factors involved in the stability of mRNA that is contained in the cDNA, or in its regulation of expression at the translation stage. Also, since a full-length cDNA contains atg codon, the translation start site, in the 5'-region, it can be translated into a protein in a correct frame. Therefore, it is possible to produce a large amount of the protein encoded by the cDNA or to analyze biological activity of the expressed protein by utilizing an appropriate expression system. Thus, analysis of a full-length cDNA provides valuable information which complements the information from genome sequencing. Also, full-length cDNA clones that can be expressed are extremely valuable in empirical analysis of gene function and in industrial application.

Therefore, if a novel human full-length cDNA is isolated, it can be used for developing medicines for diseases in which the gene is involved. The protein encoded by the gene can be used as a drug by itself. Thus, it has great significance to obtain a full-length cDNA encoding a novel human protein.

In particular, human secretory proteins or membrane proteins would be useful by itself as a medicine like tissue plasminogen activator (TPA), or as a target of medicines like membrane receptors. In addition, genes for signal transduction-related proteins (protein kinases, etc.), glycoprotein-related proteins, transcription-related proteins, etc. are genes whose relationships to human diseases have been elucidated. Moreover, genes for disease-related proteins form a gene group rich in genes whose relationships to human diseases have been elucidated.

Therefore, it has great significance to isolate novel full-length cDNA clones of human, only few of which has been isolated. Especially, isolation of a novel cDNA clone encoding a secretory protein or membrane protein is desired since the protein itself would be useful as a medicine, and also the clones potentially include a gene involved in diseases. In addition, genes encoding proteins that are involved in signal transduction, glycoprotein, transcription, or diseases are expected to be useful as target molecules for therapy, or as medicines themselves. These genes form a gene group predicted to be strongly involved in diseases. Thus, identification of the full-length cDNA clones encoding those proteins has great significance.

SUMMARY OF THE INVENTION

An objective of the present invention is to provide polynucleotides encoding novel polypeptides, polypeptides encoded by the polynucleotides, and novel usages of these.

The inventors have developed a method for efficiently cloning, from a cDNA library having very high fullness-ratio, a human full-length cDNA that is predicted to be a full-length cDNA clone, where the cDNA library is synthesized by an improved method (WO 01/04286) of the oligo-capping method (K. Maruyama and S. Sugano, Gene, 138: 171–174 (1994); Y. Suzuki et al., Gene, 200: 149–156 (1997)). Then, the nucleotide sequences of cDNA clones whose fullness ratio is high, obtained by this method, were determined mainly from their 5'-ends, and, if required, from 3'-ends.

Further, representative clones, which were estimated to be novel and full-length, among the clones obtained, were analyzed for their full-length nucleotide sequences. The determined full-length nucleotide sequences were analyzed by BLAST homology search of the databases shown below.

Because the homology search of the present invention is carried out based on the information of full-length cDNAs including the entire coding regions, homology to every part of a polypeptide can be analyzed. Thus, in the present invention, the reliability of homology search has been greatly improved.

[1] SwissProt,
[2] GenBank,
[3] UniGene (Human), and
[4] nr (a protein database, which has been constructed by combining data of coding sequences (CDS) in nucleotide sequences deposited in GenBank, and data of SwissProt, PDB, PIR, and PRF; overlapping sequences have been removed.)

Further, the gene expression profiles of cDNA clones whose full-length nucleotide sequence had been determined were studied by analyzing the large-scale cDNA database constructed based on the 5'-end nucleotide sequences of cDNAs obtained. In addition to the analysis for the expression profile by computer, the profiles of gene expression in living cells were also determined by PCR. The present inventors revealed the usefulness of the genes of the present invention based on these analysis results.

In the present invention, gene functions were revealed by the analysis of expression profiles in silico based on the information of full-length nucleotide sequences. The expression profiles used in the expression frequency analysis were studied based on the database containing sufficient amount of fragment sequence data. The expression frequency analysis was carried out by referring, for these expression profiles, to the full-length nucleotide sequences of many cDNA clones obtained in the present invention. Thus, a highly reliable analysis can be achieved by referring to the full-length nucleotide sequences of a wide variety of genes for the sufficiently large population for analysis (expression profiles). Namely, the results of expression frequency analysis using the full-length sequences of the present invention more precisely reflect the gene expression frequency in tissues and cells from which a certain cDNA library was derived. In other words, the information of full-length cDNA nucleotide sequence of the present invention made it possible to achieve the highly reliable expression frequency analysis.

The full-length cDNA clones of this invention were obtained by the method comprising the steps of [1] preparing libraries containing cDNAs with the high fullness ratio by oligo-capping, and [2] assembling 5'-end sequences and selecting one with the highest probability of completeness in length in the cluster formed (there are many clones longer in the 5'-end direction). However, the uses of primers designed based on the 5'- and 3'-end sequences of polynucleotides provided by the present invention enable readily obtaining full-length cDNAs without such a special technique. The primer, which is designed to be used for obtaining cDNAs capable of being expressed, is not limited to the 5'- and 3'-end sequences of polynucleotide.

Specifically, the present invention relates to a polynucleotide selected from the group consisting of the following (a) to (g):

(a) a polynucleotide comprising a protein-coding region of the nucleotide sequence of any one of SEQ ID NOs shown in Table 1;
(b) a polynucleotide encoding a polypeptide comprising the amino acid sequence of any one of SEQ ID NOs shown in Table 1;
(c) a polynucleotide comprising a nucleotide sequence encoding a polypeptide comprising the amino acid sequence of any one of SEQ ID NOs shown in Table 1, wherein, in said amino acid sequence, one or more amino acids have been substituted, deleted, inserted, and/or added, and wherein said nucleotide sequence encodes a polypeptide functionally equivalent to a polypeptide comprising the selected amino acid sequence;
(d) a polynucleotide hybridizing under stringent conditions to a polynucleotide comprising the nucleotide sequence of any one of SEQ ID NOs shown in Table 1, wherein said nucleotide sequence encodes a polypeptide functionally equivalent to a polypeptide encoded by the selected nucleotide sequence;
(e) a polynucleotide comprising a nucleotide sequence encoding a partial amino acid sequence of a polypeptide encoded by the polynucleotide according to any one of (a) to (d);
(f) a polynucleotide comprising a nucleotide sequence having at least 70% identity to the nucleotide sequence of (a); and
(g) a polynucleotide comprising a nucleotide sequence having at least 90% identity to the nucleotide sequence of (a).

The present invention also relates to a polypeptide encoded by the above-mentioned polynucleotide or a partial peptide thereof, an antibody binding to the polypeptide or the peptide, and a method for immunologically assaying the polypeptide or the peptide, which comprises the steps of contacting the polypeptide or the peptide with the antibody, and observing the binding between the two.

Furthermore, the present invention features a vector comprising the above-mentioned polynucleotide, a transformant carrying the polynucleotide or the vector, a transformant carrying the polynucleotide or the vector in an expressible manner, and a method for producing the polypeptide or the peptide, which comprises the steps of culturing the transformant and recovering an expression product.

Another feature of the present invention is an oligonucleotide comprising at least 15 nucleotides, said oligonucleotide comprising a nucleotide sequence complementary to the nucleotide sequence of any one of SEQ ID NOs: 1 to 1639 or to a complementary strand thereof. This oligonucleotide can be used as a primer for synthesizing the above-mentioned polynucleotide or used as a probe for detecting the polynucleotide. The present invention includes an antisense polynucleotide against the polynucleotide or a part thereof, and a method for detecting the polynucleotide, which comprises the following steps of:
a) incubating a target polynucleotide with the oligonucleotide under hybridizable conditions, and
b) detecting hybridization of the target polynucleotide with the oligonucleotide.

Still another feature of the present invention is a database of polynucleotides and/or polypeptides, said database comprising information on at least one of the nucleotide sequences of SEQ ID NOs: 1 to 1639 and/or on at least one of the amino acid sequences of SEQ ID NOs: 1640 to 3278.

Herein, "polynucleotide" is defined as a molecule, such as DNA and RNA, in which multiple nucleotides are polymerized. There are no limitations on the number of the polymerized nucleotides. In case that the polymer contains relatively low number of nucleotides, it is also described as an "oligonucleotide", which is included in the "polynucleotide" of the present invention. The polynucleotide or the oligonucleotide of the present invention can be a natural or chemically synthesized product. Alternatively, it can be synthesized using a template polynucleotide by an enzymatic reaction such as PCR. Furthermore, the polynucleotide of the present invention may be modified chemically.

Moreover, not only a single-strand polynucleotide but also a double-strand polynucleotide is included in the present invention. In this specification, especially in claims, when the polynucleotide is described merely as "polynucleotide", it means not only a single-strand polynucleotide but also a double-strand polynucleotide. When it means double-strand polynucleotide, the nucleotide sequence of only one chain is indicated. However, based on the nucleotide sequence of a sense chain, the nucleotide sequence of the complementary strand thereof is essentially determined.

As used herein, an "isolated polynucleotide" is a polynucleotide the structure of which is not identical to that of any naturally occurring polynucleotide or to that of any fragment of a naturally occurring genomic polynucleotide spanning more than three separate genes. The term therefore includes, for example, (a) a DNA which has the sequence of part of a naturally occurring genomic DNA molecule in the genome of the organism in which it naturally occurs; (b) a polynucleotide incorporated into a vector or into the genomic DNA of a prokaryote or eukaryote in a manner such that the resulting molecule is not identical to any naturally occurring vector or genomic DNA; (c) a separate molecule such as a cDNA, a genomic fragment, a fragment produced by polymerase chain reaction (PCR), or a restriction fragment; and (d) a recombinant nucleotide sequence that is part of a hybrid gene, i.e., a gene encoding a fusion polypeptide. Specifically excluded from this definition are polynucleotides of DNA molecules present in mixtures of different (i) DNA molecules, (ii) transfected cells, or (iii) cell clones; e.g., as these occur in a DNA library such as a cDNA or genomic DNA library.

The term "substantially pure" as used herein in reference to a given protein or polypeptide means that the protein or polypeptide is substantially free from other biological macromolecules. For example, the substantially pure protein or polypeptide is at least 75%, 80%, 85%, 95%, or 99% pure by dry weight. Purity can be measured by any appropriate standard method known in the art, for example, by column chromatography, polyacrylamide gel electrophoresis, or HPLC analysis.

All the cDNAs provided by the present invention are full-length cDNAs. The "full-length cDNA" herein means that the cDNA contains the ATG codon, which is the start point of translation therein. The untranslated regions upstream and downstream of the protein-coding region, both of which are naturally contained in natural mRNAs, are not indispensable. It is preferable that the full-length cDNAs of the present invention contain the stop codon.

DETAILED DESCRIPTION OF THE INVENTION

Figure 1:
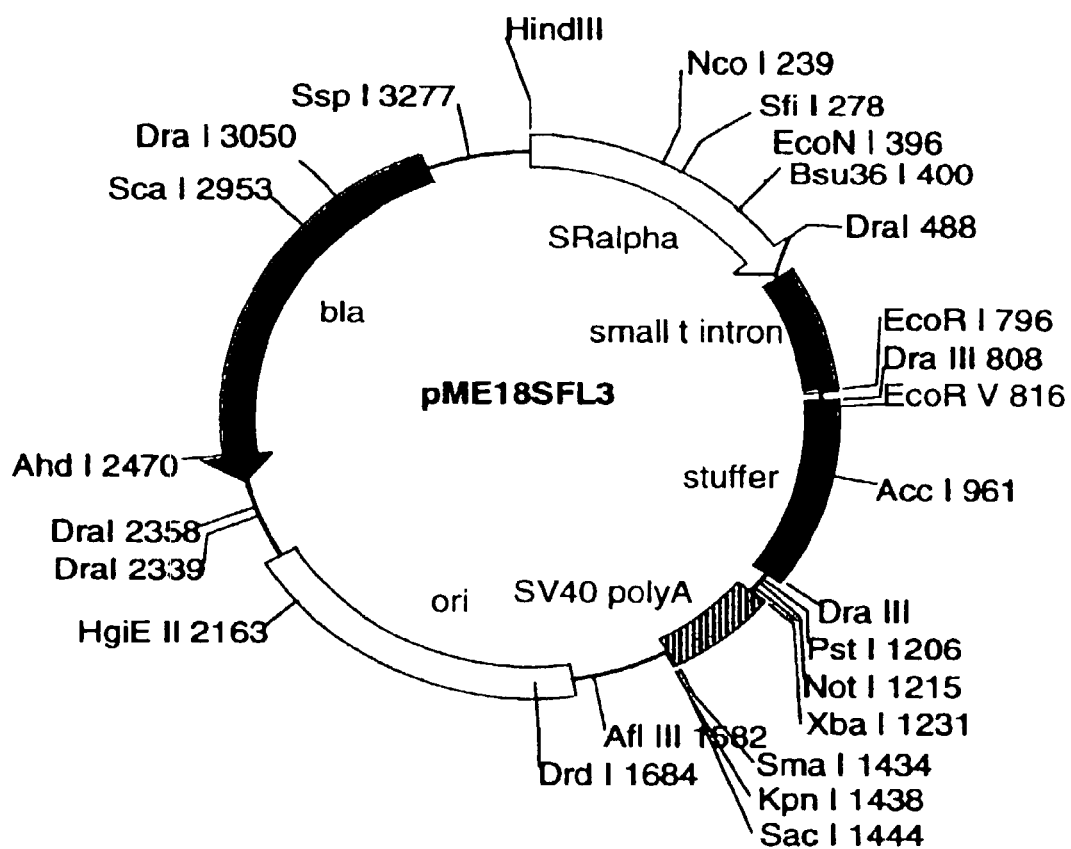
FIG. 1 shows the restriction map of the vector pME18SFL3.

All the clones (1639 clones) of the present invention are novel and encode the full-length polypeptides. Further, all the clones are cDNAs with the high fullness ratio, which were obtained by oligo-capping method, and also clones which are not identical to any of known human mRNAs (namely, novel clones) selected by searching, for the 5'-end sequences, mRNA sequences with the annotation of "complete cds" in the GenBank and UniGene databases by using the BLAST homology search [S. F. Altschul, W. Gish, W. Miller, E. W. Myers & D. J. Lipman, J. Mol. Biol., 215: 403–410 (1990); W. Gish & D. J. States, Nature Genet., 3: 266–272 (1993)]; they are also clones that were assumed to have higher fullness ratio among the members in the cluster formed by assembling. Most of the clones assessed to have high fullness ratio in the cluster had the nucleotide sequences longer in the 5'-end direction.

All the full-length cDNAs of the present invention can be synthesized by a method such as PCR (Current protocols in Molecular Biology edit. Ausubel et al. (1987) Publish. John Wiley & Sons Section 6.1–6.4) using primer sets designed based on the 5'-end and 3'-end sequences or using primer sets of primers designed based on the 5'-end sequences and a primer of oligo dT sequence corresponding to poly A sequence. Table 1 contains the clone names of full-length cDNA of 1639 clones of the present invention, SEQ ID NOs of the full-length nucleotide sequences, CDS portions deduced from the full-length nucleotide sequences, and SEQ ID NOs of the translated amino acids. The positions of CDS are shown according to the rule of "DDBJ/EMBL/GenBank Feature Table Definition". The start position number corresponds to the first letter of "ATG" that is the nucleotide triplet encoding methionine; the termination position number corresponds to the third letter of the stop codon. These are indicated being flanked with the mark "..". However, with respect to the clones having no stop codon, the termination position is indicated by the mark ">" according to the above rule.

TABLE 1

| Clone name | SEQ ID NO. of nucleotide sequence | Position of CDS | SEQ ID NO. of amino acid sequence |
| --- | --- | --- | --- |
| 3NB6910000180 | 1 | 505 . . . 1434 | 1640 |
| 3NB6910000850 | 2 | 132 . . . 836 | 1641 |
| 3NB6910001160 | 3 | 85 . . . 702 | 1642 |
| 3NB6910001290 | 4 | 194 . . . 706 | 1643 |
| 3NB6910001730 | 5 | 166 . . . >1755 | 1644 |
| 3NB6920000290 | 6 | 991 . . . 1335 | 1645 |
| 3NB6920002810 | 7 | 8 . . . 1375 | 1646 |
| 3NB6920003300 | 8 | 128 . . . 901 | 1647 |
| 3NB6920005450 | 9 | 21 . . . 809 | 1648 |
| 3NB6920009120 | 10 | 247 . . . 1983 | 1649 |
| 3NB6920010020 | 11 | 59 . . . 913 | 1650 |
| 3NB6920010220 | 12 | 108 . . . 1289 | 1651 |
| 3NB6920013490 | 13 | 402 . . . 1214 | 1652 |
| 3NB6920014330 | 14 | 674 . . . 1516 | 1653 |
| 3NB6920014710 | 15 | 369 . . . >1990 | 1654 |
| 3NB6920015110 | 16 | 306 . . . 1163 | 1655 |
| 3NB6920015280 | 17 | 162 . . . 1847 | 1656 |
| 3NB6920015570 | 18 | 407 . . . 1903 | 1657 |
| 3NB6920016370 | 19 | 25 . . . 348 | 1658 |
| 3NB6920017190 | 20 | 151 . . . 1068 | 1659 |
| ADRGL10000020 | 21 | 7 . . . 1773 | 1660 |
| ADRGL10000180 | 22 | 1742 . . . 2110 | 1661 |
| ADRGL10000650 | 23 | 425 . . . 1072 | 1662 |
| ADRGL10001600 | 24 | 10 . . . 1407 | 1663 |
| ADRGL10001650 | 25 | 107 . . . 1387 | 1664 |
| ADRGL10001820 | 26 | 2165 . . . 2467 | 1665 |
| ADRGL20000740 | 27 | 114 . . . 1349 | 1666 |
| ADRGL20003230 | 28 | 118 . . . 516 | 1667 |
| ADRGL20004280 | 29 | 169 . . . 477 | 1668 |
| ASTRO10000180 | 30 | 158 . . . 2716 | 1669 |
| ASTRO20000950 | 31 | 110 . . . 1315 | 1670 |
| ASTRO20004170 | 32 | 1121 . . . 1732 | 1671 |
| ASTRO20004800 | 33 | 1177 . . . 1539 | 1672 |
| BGGI110002850 | 34 | 1119 . . . 1460 | 1673 |
| BGGI120001610 | 35 | 454 . . . 1185 | 1674 |
| BGGI120005330 | 36 | 79 . . . 1548 | 1675 |
| BGGI120005440 | 37 | 453 . . . 1661 | 1676 |
| BGGI120006840 | 38 | 140 . . . 1303 | 1677 |
| BGGI120006930 | 39 | 38 . . . 1627 | 1678 |
| BGGI120010970 | 40 | 264 . . . 2078 | 1679 |
| BGGI120017140 | 41 | 140 . . . 1009 | 1680 |
| BNGH410000030 | 42 | 780 . . . 1967 | 1681 |

TABLE 1-continued

| Clone name | SEQ ID NO. of nucleotide sequence | Position of CDS | SEQ ID NO. of amino acid sequence |
|---|---|---|---|
| BNGH410000130 | 43 | 1087 . . . 1539 | 1682 |
| BNGH410000170 | 44 | 1466 . . . 1801 | 1683 |
| BNGH410000290 | 45 | 51 . . . 1661 | 1684 |
| BNGH410000330 | 46 | 2453 . . . 2782 | 1685 |
| BNGH410000340 | 47 | 539 . . . 1477 | 1686 |
| BNGH410000390 | 48 | 134 . . . 1135 | 1687 |
| BNGH410000800 | 49 | 232 . . . 549 | 1688 |
| BNGH410001040 | 50 | 146 . . . 1651 | 1689 |
| BNGH410001180 | 51 | 166 . . . >2624 | 1690 |
| BNGH410001370 | 52 | 61 . . . 1740 | 1691 |
| BNGH410001530 | 53 | 1368 . . . 1760 | 1692 |
| BNGH410001770 | 54 | 82 . . . 1773 | 1693 |
| BNGH410001900 | 55 | 113 . . . >2458 | 1694 |
| BNGH410001980 | 56 | 97 . . . 1476 | 1695 |
| BNGH420004740 | 57 | 1171 . . . 1473 | 1696 |
| BNGH420005320 | 58 | 354 . . . 1937 | 1697 |
| BRACE10000200 | 59 | 959 . . . 1267 | 1698 |
| BRACE10000420 | 60 | 214 . . . 1332 | 1699 |
| BRACE10000700 | 61 | 181 . . . 900 | 1700 |
| BRACE10000730 | 62 | 168 . . . 698 | 1701 |
| BRACE10000930 | 63 | 45 . . . 1388 | 1702 |
| BRACE10001150 | 64 | 76 . . . 624 | 1703 |
| BRACE10001590 | 65 | 225 . . . 767 | 1704 |
| BRACE10001660 | 66 | 777 . . . 1325 | 1705 |
| BRACE10001690 | 67 | 557 . . . 889 | 1706 |
| BRACE10001870 | 68 | 85 . . . 1704 | 1707 |
| BRACE20000770 | 69 | 162 . . . 605 | 1708 |
| BRACE20001000 | 70 | 1122 . . . 1430 | 1709 |
| BRACE20001410 | 71 | 229 . . . 975 | 1710 |
| BRACE20002800 | 72 | 35 . . . 1663 | 1711 |
| BRACE20003320 | 73 | 471 . . . 2063 | 1712 |
| BRACE20004210 | 74 | 1562 . . . 2716 | 1713 |
| BRACE20005050 | 75 | 711 . . . 1013 | 1714 |
| BRACE20005250 | 76 | 617 . . . 1144 | 1715 |
| BRACE20005450 | 77 | 184 . . . 498 | 1716 |
| BRACE20005650 | 78 | 272 . . . 841 | 1717 |
| BRACE20005770 | 79 | 514 . . . 816 | 1718 |
| BRACE20006980 | 80 | 85 . . . 1446 | 1719 |
| BRACE20007180 | 81 | 1263 . . . 1679 | 1720 |
| BRACE20008850 | 82 | 596 . . . >1809 | 1721 |
| BRACE20009880 | 83 | 1761 . . . 2069 | 1722 |
| BRACE20010650 | 84 | 1257 . . . 1922 | 1723 |
| BRACE20010700 | 85 | 1680 . . . >1989 | 1724 |
| BRACE20011170 | 86 | 87 . . . 410 | 1725 |
| BRACE20011430 | 87 | 1550 . . . 2041 | 1726 |
| BRACE20011880 | 88 | 742 . . . 1104 | 1727 |
| BRACE20013400 | 89 | 1495 . . . 1890 | 1728 |
| BRACE20013520 | 90 | 677 . . . 1048 | 1729 |
| BRACE20013740 | 91 | 1694 . . . 2317 | 1730 |
| BRACE20013750 | 92 | 821 . . . 1192 | 1731 |
| BRACE20014230 | 93 | 1523 . . . 1978 | 1732 |
| BRACE20014530 | 94 | 1747 . . . 2205 | 1733 |
| BRACE20014550 | 95 | 921 . . . 1838 | 1734 |
| BRACE20014770 | 96 | 351 . . . 1286 | 1735 |
| BRACE20014920 | 97 | 1306 . . . 1638 | 1736 |
| BRACE20015080 | 98 | 39 . . . 545 | 1737 |
| BRACE20015430 | 99 | 235 . . . 579 | 1738 |
| BRACE20016730 | 100 | 445 . . . 828 | 1739 |
| BRACE20016920 | 101 | 96 . . . 569 | 1740 |
| BRACE20017370 | 102 | 1612 . . . 2082 | 1741 |
| BRACE20018550 | 103 | 152 . . . 2008 | 1742 |
| BRACE20018590 | 104 | 902 . . . 1408 | 1743 |
| BRACE20018650 | 105 | 1143 . . . 1529 | 1744 |
| BRACE20018980 | 106 | 2178 . . . 2558 | 1745 |
| BRACE20019440 | 107 | 225 . . . 1205 | 1746 |
| BRACE20020500 | 108 | 605 . . . 1372 | 1747 |
| BRACE20020910 | 109 | 283 . . . 1176 | 1748 |
| BRACE20021510 | 110 | 1003 . . . 1653 | 1749 |
| BRACE20021760 | 111 | 393 . . . 1148 | 1750 |
| BRACE20022020 | 112 | 717 . . . 1727 | 1751 |
| BRACE20022270 | 113 | 3 . . . 353 | 1752 |
| BRACE20024090 | 114 | 165 . . . 845 | 1753 |
| BRACE20024310 | 115 | 2292 . . . 2618 | 1754 |
| BRACE20024680 | 116 | 65 . . . 1129 | 1755 |
| BRACE20024780 | 117 | 297 . . . 1154 | 1756 |
| BRACE20024950 | 118 | 49 . . . 369 | 1757 |
| BRACE20025900 | 119 | 636 . . . 941 | 1758 |
| BRACE20026350 | 120 | 106 . . . 753 | 1759 |
| BRACE20026850 | 121 | 113 . . . 1063 | 1760 |
| BRACE20027360 | 122 | 1147 . . . 1680 | 1761 |
| BRACE20027520 | 123 | 613 . . . 1215 | 1762 |
| BRACE20027550 | 124 | 168 . . . 578 | 1763 |
| BRACE20027720 | 125 | 169 . . . 777 | 1764 |
| BRACE20027920 | 126 | 105 . . . 1496 | 1765 |
| BRACE20027960 | 127 | 1731 . . . 2132 | 1766 |
| BRACE20028120 | 128 | 408 . . . 917 | 1767 |
| BRACE20028600 | 129 | 784 . . . 1593 | 1768 |
| BRACE20028610 | 130 | 774 . . . 1196 | 1769 |
| BRACE20028960 | 131 | 63 . . . 1472 | 1770 |
| BRACE20030780 | 132 | 236 . . . 637 | 1771 |
| BRACE20031100 | 133 | 214 . . . 2565 | 1772 |
| BRACE20032850 | 134 | 698 . . . 1327 | 1773 |
| BRACE20033190 | 135 | 202 . . . 531 | 1774 |
| BRACE20033980 | 136 | 811 . . . 1215 | 1775 |
| BRACE20034310 | 137 | 526 . . . 1461 | 1776 |
| BRACE20034490 | 138 | 1316 . . . 1699 | 1777 |
| BRACE20035160 | 139 | 492 . . . 896 | 1778 |
| BRACE20035270 | 140 | 572 . . . 1099 | 1779 |
| BRACE20035390 | 141 | 891 . . . 1211 | 1780 |
| BRACE20035940 | 142 | 80 . . . 601 | 1781 |
| BRACE20071380 | 143 | 190 . . . 1335 | 1782 |
| BRACE20071530 | 144 | 62 . . . 604 | 1783 |
| BRACE20071740 | 145 | 118 . . . 1800 | 1784 |
| BRACE20071970 | 146 | 1584 . . . 1895 | 1785 |
| BRACE20072010 | 147 | 422 . . . 1114 | 1786 |
| BRACE20072320 | 148 | 266 . . . 583 | 1787 |
| BRACE20072810 | 149 | 858 . . . 1193 | 1788 |
| BRACE20074010 | 150 | 92 . . . 1246 | 1789 |
| BRACE20074470 | 151 | 742 . . . 2109 | 1790 |
| BRACE20075020 | 152 | 2248 . . . 2553 | 1791 |
| BRACE20075270 | 153 | 1740 . . . 2285 | 1792 |
| BRACE20075380 | 154 | 1455 . . . 1889 | 1793 |
| BRACE20075630 | 155 | 996 . . . 1445 | 1794 |
| BRACE20076210 | 156 | 850 . . . 1509 | 1795 |
| BRACE20076410 | 157 | 78 . . . 1040 | 1796 |
| BRACE20076460 | 158 | 1368 . . . 1709 | 1797 |
| BRACE20076630 | 159 | 634 . . . 996 | 1798 |
| BRACE20076850 | 160 | 598 . . . 984 | 1799 |
| BRACE20077080 | 161 | 119 . . . 853 | 1800 |
| BRACE20077270 | 162 | 95 . . . 445 | 1801 |
| BRACE20077610 | 163 | 239 . . . 553 | 1802 |
| BRACE20077640 | 164 | 595 . . . 900 | 1803 |
| BRACE20077670 | 165 | 317 . . . 649 | 1804 |
| BRACE20077680 | 166 | 2013 . . . 2390 | 1805 |
| BRACE20077840 | 167 | 18 . . . 524 | 1806 |
| BRACE20077980 | 168 | 855 . . . 1604 | 1807 |
| BRACE20078680 | 169 | 1144 . . . >1753 | 1808 |
| BRACE20078820 | 170 | 2 . . . 580 | 1809 |
| BRACE20079020 | 171 | 1178 . . . 1681 | 1810 |
| BRACE20079530 | 172 | 8 . . . 331 | 1811 |
| BRACE20080970 | 173 | 1025 . . . 1348 | 1812 |
| BRACE20081140 | 174 | 14 . . . 463 | 1813 |
| BRACE20083800 | 175 | 71 . . . 1201 | 1814 |
| BRACE20083850 | 176 | 183 . . . 1046 | 1815 |
| BRACE20084430 | 177 | 1035 . . . 1649 | 1816 |
| BRACE20084800 | 178 | 57 . . . 845 | 1817 |
| BRACE20084880 | 179 | 1234 . . . 1617 | 1818 |
| BRACE20086530 | 180 | 405 . . . 914 | 1819 |
| BRACE20086550 | 181 | 219 . . . 632 | 1820 |
| BRACE20087080 | 182 | 31 . . . 342 | 1821 |
| BRACE20087540 | 183 | 1013 . . . 1459 | 1822 |
| BRACE20088570 | 184 | 42 . . . 365 | 1823 |
| BRACE20089600 | 185 | 121 . . . 630 | 1824 |
| BRACE20089990 | 186 | 446 . . . 928 | 1825 |
| BRACE20090140 | 187 | 677 . . . 979 | 1826 |
| BRACE20091880 | 188 | 18 . . . 539 | 1827 |
| BRACE20092120 | 189 | 160 . . . 1959 | 1828 |
| BRACE20092740 | 190 | 255 . . . 905 | 1829 |
| BRACE20092750 | 191 | 1450 . . . 1827 | 1830 |
| BRACE20093070 | 192 | 562 . . . 1158 | 1831 |

TABLE 1-continued

| Clone name | SEQ ID NO. of nucleotide sequence | Position of CDS | SEQ ID NO. of amino acid sequence |
|---|---|---|---|
| BRACE20093110 | 193 | 1581 ... 1940 | 1832 |
| BRACE20093610 | 194 | 1337 ... >1783 | 1833 |
| BRACE20094370 | 195 | 826 ... 1149 | 1834 |
| BRACE20095170 | 196 | 1657 ... 1959 | 1835 |
| BRAWH10000010 | 197 | 1241 ... 2050 | 1836 |
| BRAWH10000020 | 198 | 869 ... >1920 | 1837 |
| BRAWH10000070 | 199 | 560 ... 2242 | 1838 |
| BRAWH10000370 | 200 | 161 ... 787 | 1839 |
| BRAWH10000940 | 201 | 203 ... 2020 | 1840 |
| BRAWH10001300 | 202 | 256 ... 2025 | 1841 |
| BRAWH10001620 | 203 | 109 ... 1128 | 1842 |
| BRAWH10001640 | 204 | 185 ... 613 | 1843 |
| BRAWH10001680 | 205 | 229 ... 987 | 1844 |
| BRAWH10001740 | 206 | 277 ... 1383 | 1845 |
| BRAWH10001800 | 207 | 182 ... 601 | 1846 |
| BRAWH20000340 | 208 | 2214 ... 2537 | 1847 |
| BRAWH20000480 | 209 | 218 ... 1117 | 1848 |
| BRAWH20000930 | 210 | 1521 ... 1904 | 1849 |
| BRAWH20001090 | 211 | 356 ... 2014 | 1850 |
| BRAWH20001770 | 212 | 69 ... 476 | 1851 |
| BRAWH20002480 | 213 | 1385 ... 1777 | 1852 |
| BRAWH20003230 | 214 | 232 ... 780 | 1853 |
| BRAWH20004430 | 215 | 222 ... 2186 | 1854 |
| BRAWH20004760 | 216 | 22 ... 564 | 1855 |
| BRAWH20005030 | 217 | 1431 ... 1754 | 1856 |
| BRAWH20005220 | 218 | 98 ... 700 | 1857 |
| BRAWH20005540 | 219 | 416 ... 811 | 1858 |
| BRAWH20006330 | 220 | 854 ... 1741 | 1859 |
| BRAWH20006510 | 221 | 438 ... 1163 | 1860 |
| BRAWH20006860 | 222 | 599 ... 2179 | 1861 |
| BRAWH20006970 | 223 | 1178 ... 1579 | 1862 |
| BRAWH20008660 | 224 | 505 ... 924 | 1863 |
| BRAWH20008920 | 225 | 2179 ... 2529 | 1864 |
| BRAWH20009010 | 226 | 1139 ... 1540 | 1865 |
| BRAWH20009440 | 227 | 422 ... 1603 | 1866 |
| BRAWH20009840 | 228 | 826 ... 1764 | 1867 |
| BRAWH20011030 | 229 | 1881 ... 2186 | 1868 |
| BRAWH20011290 | 230 | 71 ... 1444 | 1869 |
| BRAWH20011410 | 231 | 251 ... 718 | 1870 |
| BRAWH20011660 | 232 | 104 ... 1411 | 1871 |
| BRAWH20012030 | 233 | 55 ... 684 | 1872 |
| BRAWH20014180 | 234 | 5 ... 751 | 1873 |
| BRAWH20014380 | 235 | 795 ... 1130 | 1874 |
| BRAWH20014610 | 236 | 743 ... 1216 | 1875 |
| BRAWH20014840 | 237 | 404 ... 2227 | 1876 |
| BRAWH20015030 | 238 | 861 ... 1232 | 1877 |
| BRAWH20036890 | 239 | 319 ... 864 | 1878 |
| BRAWH20036930 | 240 | 28 ... 3078 | 1879 |
| BRAWH20038320 | 241 | 998 ... 1306 | 1880 |
| BRAWH20040950 | 242 | 1867 ... 2205 | 1881 |
| BRAWH20047310 | 243 | 47 ... 547 | 1882 |
| BRAWH20052250 | 244 | 30 ... 398 | 1883 |
| BRAWH20059980 | 245 | 161 ... 1900 | 1884 |
| BRAWH20060440 | 246 | 65 ... 2083 | 1885 |
| BRAWH20064500 | 247 | 209 ... 1675 | 1886 |
| BRAWH20064930 | 248 | 403 ... 1908 | 1887 |
| BRAWH20066220 | 249 | 1395 ... >2080 | 1888 |
| BRAWH20069600 | 250 | 1482 ... 1976 | 1889 |
| BRAWH20069890 | 251 | 444 ... 1226 | 1890 |
| BRAWH20074060 | 252 | 1028 ... 1429 | 1891 |
| BRAWH20076050 | 253 | 45 ... 1469 | 1892 |
| BRAWH20087060 | 254 | 1160 ... 2053 | 1893 |
| BRAWH20089030 | 255 | 346 ... 825 | 1894 |
| BRAWH20089560 | 256 | 87 ... 2906 | 1895 |
| BRAWH20092270 | 257 | 223 ... 1062 | 1896 |
| BRAWH20092610 | 258 | 258 ... 791 | 1897 |
| BRAWH20093600 | 259 | 21 ... 644 | 1898 |
| BRAWH20094850 | 260 | 1213 ... 1536 | 1899 |
| CD34C20000510 | 261 | 7 ... 1380 | 1900 |
| CTONG20003030 | 262 | 2228 ... 2641 | 1901 |
| CTONG20005890 | 263 | 294 ... 3017 | 1902 |
| CTONG20007710 | 264 | 1088 ... 1468 | 1903 |
| CTONG20008270 | 265 | 863 ... 2080 | 1904 |
| CTONG20011390 | 266 | 50 ... 3337 | 1905 |
| CTONG20013200 | 267 | 123 ... 1823 | 1906 |
| CTONG20013660 | 268 | 3 ... 1571 | 1907 |
| CTONG20015330 | 269 | 87 ... 527 | 1908 |
| CTONG20018200 | 270 | 42 ... >3217 | 1909 |
| CTONG20019110 | 271 | 511 ... 1455 | 1910 |
| CTONG20019550 | 272 | 162 ... >3684 | 1911 |
| CTONG20020730 | 273 | 20 ... 1342 | 1912 |
| CTONG20021430 | 274 | 74 ... >2745 | 1913 |
| CTONG20024180 | 275 | 641 ... 2452 | 1914 |
| CTONG20024530 | 276 | 618 ... 986 | 1915 |
| CTONG20025580 | 277 | 1281 ... 2177 | 1916 |
| CTONG20027210 | 278 | 366 ... >2763 | 1917 |
| CTONG20028030 | 279 | 837 ... 1280 | 1918 |
| CTONG20028160 | 280 | 301 ... 2799 | 1919 |
| CTONG20028200 | 281 | 148 ... >3543 | 1920 |
| CTONG20029650 | 282 | 118 ... >2551 | 1921 |
| CTONG20037820 | 283 | 332 ... 895 | 1922 |
| CTONG20047160 | 284 | 113 ... 1021 | 1923 |
| CTONG20055530 | 285 | 63 ... >2305 | 1924 |
| CTONG20064490 | 286 | 1533 ... 1859 | 1925 |
| D3OST20001840 | 287 | 77 ... 1429 | 1926 |
| DFNES20002120 | 288 | 1263 ... 1940 | 1927 |
| DFNES20002680 | 289 | 505 ... 2571 | 1928 |
| DFNES20002920 | 290 | 52 ... 639 | 1929 |
| DFNES20003350 | 291 | 33 ... 1007 | 1930 |
| DFNES20004320 | 292 | 1517 ... 1849 | 1931 |
| FCBBF10005980 | 293 | 375 ... 2141 | 1932 |
| FCBBF10006180 | 294 | 1161 ... 1463 | 1933 |
| FCBBF10006750 | 295 | 106 ... 1023 | 1934 |
| FCBBF10006860 | 296 | 521 ... 865 | 1935 |
| FCBBF10006870 | 297 | 410 ... 1831 | 1936 |
| FCBBF10006910 | 298 | 111 ... 482 | 1937 |
| FCBBF10007320 | 299 | 1236 ... 1850 | 1938 |
| FCBBF10007600 | 300 | 68 ... 523 | 1939 |
| FCBBF20000940 | 301 | 249 ... 2147 | 1940 |
| FCBBF20001050 | 302 | 29 ... 421 | 1941 |
| FCBBF20001950 | 303 | 1565 ... 1888 | 1942 |
| FCBBF20002320 | 304 | 921 ... 2003 | 1943 |
| FCBBF20002760 | 305 | 221 ... 895 | 1944 |
| FCBBF20005760 | 306 | 693 ... 1073 | 1945 |
| FCBBF20005910 | 307 | 29 ... >2161 | 1946 |
| FCBBF20006770 | 308 | 265 ... 600 | 1947 |
| FCBBF20007330 | 309 | 745 ... 1077 | 1948 |
| FCBBF20008080 | 310 | 180 ... 821 | 1949 |
| FCBBF20008150 | 311 | 641 ... 1762 | 1950 |
| FCBBF20009400 | 312 | 360 ... 749 | 1951 |
| FCBBF20009510 | 313 | 218 ... 1333 | 1952 |
| FCBBF20012110 | 314 | 136 ... 1776 | 1953 |
| FCBBF20012990 | 315 | 758 ... 1168 | 1954 |
| FCBBF20014800 | 316 | 146 ... 1957 | 1955 |
| FCBBF20015380 | 317 | 302 ... 1246 | 1956 |
| FCBBF20016720 | 318 | 51 ... 488 | 1957 |
| FCBBF20017180 | 319 | 236 ... 598 | 1958 |
| FCBBF20017200 | 320 | 2306 ... 2767 | 1959 |
| FCBBF40002820 | 321 | 207 ... 1247 | 1960 |
| FCBBF50002610 | 322 | 126 ... 1634 | 1961 |
| FEBRA20000350 | 323 | 724 ... 1764 | 1962 |
| FEBRA20000530 | 324 | 359 ... 2221 | 1963 |
| FEBRA20001050 | 325 | 496 ... 2355 | 1964 |
| FEBRA20001290 | 326 | 872 ... 1192 | 1965 |
| FEBRA20003110 | 327 | 386 ... 964 | 1966 |
| FEBRA20003300 | 328 | 1504 ... 1881 | 1967 |
| FEBRA20003770 | 329 | 398 ... 2464 | 1968 |
| FEBRA20003780 | 330 | 454 ... 873 | 1969 |
| FEBRA20003910 | 331 | 1728 ... 2057 | 1970 |
| FEBRA20003970 | 332 | 162 ... 1469 | 1971 |
| FEBRA20003990 | 333 | 845 ... 2404 | 1972 |
| FEBRA20004040 | 334 | 21 ... 449 | 1973 |
| FEBRA20004150 | 335 | 836 ... 2494 | 1974 |
| FEBRA20004520 | 336 | 113 ... 442 | 1975 |
| FEBRA20004540 | 337 | 934 ... 2484 | 1976 |
| FEBRA20004910 | 338 | 1417 ... 1926 | 1977 |
| FEBRA20005360 | 339 | 254 ... 1453 | 1978 |
| FEBRA20006560 | 340 | 34 ... 615 | 1979 |
| FEBRA20006800 | 341 | 303 ... 1040 | 1980 |
| FEBRA20006900 | 342 | 1268 ... 1669 | 1981 |

TABLE 1-continued

| Clone name | SEQ ID NO. of nucleotide sequence | Position of CDS | SEQ ID NO. of amino acid sequence |
|---|---|---|---|
| FEBRA20007330 | 343 | 1486 ... 2013 | 1982 |
| FEBRA20007400 | 344 | 32 ... 1123 | 1983 |
| FEBRA20007570 | 345 | 222 ... 1193 | 1984 |
| FEBRA20007710 | 346 | 1059 ... 1361 | 1985 |
| FEBRA20007720 | 347 | 267 ... 689 | 1986 |
| FEBRA20007870 | 348 | 1174 ... 1788 | 1987 |
| FEBRA20008090 | 349 | 1319 ... 1621 | 1988 |
| FEBRA20008560 | 350 | 1500 ... 1991 | 1989 |
| FEBRA20008740 | 351 | 2051 ... 2368 | 1990 |
| FEBRA20008800 | 352 | 38 ... 703 | 1991 |
| FEBRA20008810 | 353 | 377 ... 1495 | 1992 |
| FEBRA20009010 | 354 | 243 ... 638 | 1993 |
| FEBRA20009590 | 355 | 1345 ... 1677 | 1994 |
| FEBRA20009720 | 356 | 530 ... 2140 | 1995 |
| FEBRA20010930 | 357 | 239 ... 1249 | 1996 |
| FEBRA20011330 | 358 | 1795 ... 2322 | 1997 |
| FEBRA20011460 | 359 | 2219 ... 2602 | 1998 |
| FEBRA20011970 | 360 | 1672 ... 1977 | 1999 |
| FEBRA20012270 | 361 | 1933 ... 2238 | 2000 |
| FEBRA20012450 | 362 | 519 ... 2678 | 2001 |
| FEBRA20012940 | 363 | 69 ... 575 | 2002 |
| FEBRA20013510 | 364 | 990 ... 1313 | 2003 |
| FEBRA20014870 | 365 | 1567 ... 1884 | 2004 |
| FEBRA20014920 | 366 | 77 ... 2815 | 2005 |
| FEBRA20015840 | 367 | 702 ... 1853 | 2006 |
| FEBRA20015900 | 368 | 1535 ... 1882 | 2007 |
| FEBRA20015910 | 369 | 246 ... 617 | 2008 |
| FEBRA20017060 | 370 | 730 ... 1257 | 2009 |
| FEBRA20017150 | 371 | 391 ... 2799 | 2010 |
| FEBRA20017900 | 372 | 72 ... 647 | 2011 |
| FEBRA20019890 | 373 | 497 ... 2239 | 2012 |
| FEBRA20020860 | 374 | 281 ... 673 | 2013 |
| FEBRA20021910 | 375 | 1455 ... 1829 | 2014 |
| FEBRA20021940 | 376 | 17 ... 493 | 2015 |
| FEBRA20024290 | 377 | 35 ... 1933 | 2016 |
| FEBRA20024420 | 378 | 991 ... 1614 | 2017 |
| FEBRA20025250 | 379 | 251 ... 2164 | 2018 |
| FEBRA20027270 | 380 | 10 ... 930 | 2019 |
| FEBRA20027830 | 381 | 293 ... 610 | 2020 |
| FEBRA20028820 | 382 | 1337 ... 1678 | 2021 |
| FEBRA20028970 | 383 | 824 ... 1303 | 2022 |
| FEBRA20029080 | 384 | 90 ... 764 | 2023 |
| FEBRA20030540 | 385 | 292 ... 993 | 2024 |
| FEBRA20031550 | 386 | 2000 ... 2365 | 2025 |
| FEBRA20033080 | 387 | 399 ... 749 | 2026 |
| FEBRA20034290 | 388 | 348 ... 854 | 2027 |
| FEBRA20037070 | 389 | 1830 ... >2246 | 2028 |
| FEBRA20041100 | 390 | 198 ... 1010 | 2029 |
| FEBRA20041910 | 391 | 39 ... 425 | 2030 |
| FEBRA20042240 | 392 | 1373 ... 1714 | 2031 |
| FEBRA20042370 | 393 | 51 ... 938 | 2032 |
| FEBRA20042930 | 394 | 2321 ... >2652 | 2033 |
| FEBRA20043250 | 395 | 394 ... >2294 | 2034 |
| FEBRA20043290 | 396 | 57 ... 2984 | 2035 |
| FEBRA20044120 | 397 | 928 ... 1263 | 2036 |
| FEBRA20044430 | 398 | 192 ... 539 | 2037 |
| FEBRA20044900 | 399 | 78 ... 1763 | 2038 |
| FEBRA20045920 | 400 | 344 ... 1438 | 2039 |
| FEBRA20048180 | 401 | 86 ... 493 | 2040 |
| FEBRA20050140 | 402 | 727 ... 2325 | 2041 |
| FEBRA20050790 | 403 | 780 ... 1295 | 2042 |
| FEBRA20052160 | 404 | 1055 ... 1411 | 2043 |
| FEBRA20053770 | 405 | 790 ... 1197 | 2044 |
| FEBRA20053800 | 406 | 213 ... 521 | 2045 |
| FEBRA20054270 | 407 | 1711 ... 2058 | 2046 |
| FEBRA20057260 | 408 | 8 ... 1789 | 2047 |
| FEBRA20057520 | 409 | 13 ... 480 | 2048 |
| FEBRA20057780 | 410 | 150 ... 641 | 2049 |
| FEBRA20057880 | 411 | 8 ... >3165 | 2050 |
| FEBRA20059980 | 412 | 1160 ... 2017 | 2051 |
| FEBRA20061500 | 413 | 26 ... 661 | 2052 |
| FEBRA20062700 | 414 | 77 ... 460 | 2053 |
| FEBRA20063150 | 415 | 32 ... 778 | 2054 |
| FEBRA20063540 | 416 | 236 ... 538 | 2055 |
| FEBRA20063540 | 417 | 1402 ... 1737 | 2056 |
| FEBRA20064760 | 418 | 340 ... 2076 | 2057 |
| FEBRA20066270 | 419 | 278 ... 691 | 2058 |
| FEBRA20066670 | 420 | 1933 ... 2496 | 2059 |
| FEBRA20067360 | 421 | 160 ... 1713 | 2060 |
| FEBRA20067930 | 422 | 1332 ... 1973 | 2061 |
| FEBRA20068730 | 423 | 171 ... 2051 | 2062 |
| FEBRA20069420 | 424 | 231 ... 1439 | 2063 |
| FEBRA20070170 | 425 | 88 ... 921 | 2064 |
| FEBRA20072000 | 426 | 47 ... 2065 | 2065 |
| FEBRA20072800 | 427 | 1850 ... 2335 | 2066 |
| FEBRA20074140 | 428 | 57 ... 371 | 2067 |
| FEBRA20074580 | 429 | 91 ... 420 | 2068 |
| FEBRA20075510 | 430 | 181 ... 606 | 2069 |
| FEBRA20075660 | 431 | 1960 ... 2298 | 2070 |
| FEBRA20076220 | 432 | 147 ... 2525 | 2071 |
| HCASM10000210 | 433 | 384 ... 1154 | 2072 |
| HCASM10000610 | 434 | 317 ... 871 | 2073 |
| HCASM10001150 | 435 | 473 ... 868 | 2074 |
| HCASM20002020 | 436 | 152 ... 469 | 2075 |
| HCASM20002140 | 437 | 408 ... 1136 | 2076 |
| HCASM20003070 | 438 | 48 ... 1865 | 2077 |
| HCASM20005340 | 439 | 1003 ... 1368 | 2078 |
| HCASM20005360 | 440 | 2211 ... 2618 | 2079 |
| HEART20000350 | 441 | 514 ... 1290 | 2080 |
| HEART20000990 | 442 | 1341 ... 1670 | 2081 |
| HEART20003090 | 443 | 1133 ... 1657 | 2082 |
| HEART20004110 | 444 | 39 ... 1415 | 2083 |
| HEART20004480 | 445 | 863 ... 1171 | 2084 |
| HEART20004920 | 446 | 159 ... 851 | 2085 |
| HEART20005060 | 447 | 95 ... 1495 | 2086 |
| HEART20005200 | 448 | 938 ... 1375 | 2087 |
| HEART20005680 | 449 | 783 ... 1139 | 2088 |
| HHDPC20000550 | 450 | 55 ... 1320 | 2089 |
| HHDPC20000950 | 451 | 338 ... 1462 | 2090 |
| HHDPC20001150 | 452 | 326 ... 925 | 2091 |
| HHDPC20001490 | 453 | 337 ... 2265 | 2092 |
| HHDPC20003150 | 454 | 506 ... 1711 | 2093 |
| HHDPC20004550 | 455 | 197 ... 2065 | 2094 |
| HHDPC20004560 | 456 | 174 ... >2424 | 2095 |
| HHDPC20004620 | 457 | 17 ... 865 | 2096 |
| HLUNG10000240 | 458 | 1439 ... 1762 | 2097 |
| HLUNG10000300 | 459 | 205 ... 555 | 2098 |
| HLUNG10000370 | 460 | 14 ... 1930 | 2099 |
| HLUNG10000640 | 461 | 144 ... 1514 | 2100 |
| HLUNG10000760 | 462 | 80 ... 1246 | 2101 |
| HLUNG10000990 | 463 | 67 ... 2370 | 2102 |
| HLUNG10001050 | 464 | 1081 ... 1614 | 2103 |
| HLUNG10001100 | 465 | 302 ... 703 | 2104 |
| HLUNG20000680 | 466 | 187 ... 1527 | 2105 |
| HLUNG20001160 | 467 | 391 ... 1434 | 2106 |
| HLUNG20001250 | 468 | 360 ... 899 | 2107 |
| HLUNG20001420 | 469 | 173 ... 1600 | 2108 |
| HLUNG20001760 | 470 | 6 ... 524 | 2109 |
| HLUNG20002550 | 471 | 1101 ... 1865 | 2110 |
| HLUNG20003140 | 472 | 36 ... 359 | 2111 |
| HLUNG20004120 | 473 | 416 ... 820 | 2112 |
| HLUNG20004800 | 474 | 1400 ... 1711 | 2113 |
| HLUNG20005010 | 475 | 37 ... 966 | 2114 |
| HSYRA10001190 | 476 | 159 ... 1712 | 2115 |
| HSYRA10001370 | 477 | 194 ... 1903 | 2116 |
| HSYRA10001480 | 478 | 27 ... 614 | 2117 |
| HSYRA10001680 | 479 | 59 ... >2245 | 2118 |
| HSYRA10001780 | 480 | 598 ... 1023 | 2119 |
| HSYRA20001350 | 481 | 218 ... 2371 | 2120 |
| HSYRA20002480 | 482 | 670 ... 972 | 2121 |
| HSYRA20002530 | 483 | 214 ... 780 | 2122 |
| HSYRA20003470 | 484 | 1134 ... 1580 | 2123 |
| HSYRA20005100 | 485 | 138 ... 1379 | 2124 |
| HSYRA20006050 | 486 | 66 ... 1199 | 2125 |
| HSYRA20006290 | 487 | 222 ... 1160 | 2126 |
| HSYRA20006400 | 488 | 648 ... 1052 | 2127 |
| HSYRA20007600 | 489 | 389 ... 1207 | 2128 |
| HSYRA20008280 | 490 | 1492 ... 1821 | 2129 |
| HSYRA20011030 | 491 | 572 ... >2236 | 2130 |
| HSYRA20011530 | 492 | 653 ... 955 | 2131 |

TABLE 1-continued

| Clone name | SEQ ID NO. of nucleotide sequence | Position of CDS | SEQ ID NO. of amino acid sequence |
|---|---|---|---|
| HSYRA20013320 | 493 | 3 . . . 956 | 2132 |
| HSYRA20014200 | 494 | 326 . . . 1237 | 2133 |
| HSYRA20014760 | 495 | 46 . . . 783 | 2134 |
| HSYRA20015740 | 496 | 117 . . . 947 | 2135 |
| HSYRA20015800 | 497 | 1100 . . . 1435 | 2136 |
| HSYRA20016210 | 498 | 81 . . . 470 | 2137 |
| HSYRA20016310 | 499 | 317 . . . 1105 | 2138 |
| IMR3210000440 | 500 | 313 . . . 1560 | 2139 |
| IMR3210000740 | 501 | 1215 . . . 1616 | 2140 |
| IMR3210000750 | 502 | 722 . . . 1054 | 2141 |
| IMR3210001580 | 503 | 125 . . . 1249 | 2142 |
| IMR3210001650 | 504 | 903 . . . 1391 | 2143 |
| IMR3210002420 | 505 | 194 . . . 1255 | 2144 |
| IMR3210002660 | 506 | 38 . . . 1423 | 2145 |
| IMR3220002230 | 507 | 25 . . . 945 | 2146 |
| IMR3220003020 | 508 | 403 . . . 1425 | 2147 |
| IMR3220006090 | 509 | 8 . . . 442 | 2148 |
| IMR3220007420 | 510 | 15 . . . 614 | 2149 |
| IMR3220007750 | 511 | 197 . . . >1670 | 2150 |
| IMR3220007910 | 512 | 934 . . . 1515 | 2151 |
| IMR3220008380 | 513 | 228 . . . 1142 | 2152 |
| IMR3220008590 | 514 | 756 . . . 1061 | 2153 |
| IMR3220008630 | 515 | 94 . . . 1197 | 2154 |
| IMR3220009190 | 516 | 31 . . . 1293 | 2155 |
| IMR3220009350 | 517 | 20 . . . 421 | 2156 |
| IMR3220009530 | 518 | 2 . . . 394 | 2157 |
| IMR3220009730 | 519 | 102 . . . >2141 | 2158 |
| IMR3220009840 | 520 | 246 . . . 554 | 2159 |
| IMR3220011850 | 521 | 271 . . . 1026 | 2160 |
| IMR3220012180 | 522 | 76 . . . 1521 | 2161 |
| IMR3220013170 | 523 | 393 . . . 1028 | 2162 |
| IMR3220013320 | 524 | 22 . . . 1140 | 2163 |
| IMR3220014350 | 525 | 807 . . . 2027 | 2164 |
| IMR3220014910 | 526 | 79 . . . 639 | 2165 |
| IMR3220016000 | 527 | 8 . . . 532 | 2166 |
| IMR3220017240 | 528 | 1114 . . . 1458 | 2167 |
| KIDNE10000080 | 529 | 346 . . . 1233 | 2168 |
| KIDNE10000280 | 530 | 1864 . . . 2181 | 2169 |
| KIDNE10000500 | 531 | 662 . . . 1108 | 2170 |
| KIDNE10001040 | 532 | 115 . . . 1656 | 2171 |
| KIDNE10001430 | 533 | 560 . . . 1051 | 2172 |
| KIDNE10001450 | 534 | 7 . . . 483 | 2173 |
| KIDNE10001520 | 535 | 74 . . . 712 | 2174 |
| KIDNE20000410 | 536 | 712 . . . 1215 | 2175 |
| KIDNE20000510 | 537 | 188 . . . 1717 | 2176 |
| KIDNE20000700 | 538 | 843 . . . 2135 | 2177 |
| KIDNE20000850 | 539 | 19 . . . 1071 | 2178 |
| KIDNE20001670 | 540 | 727 . . . 1725 | 2179 |
| KIDNE20001920 | 541 | 1648 . . . 2070 | 2180 |
| KIDNE20002440 | 542 | 163 . . . 468 | 2181 |
| KIDNE20002450 | 543 | 1273 . . . 1653 | 2182 |
| KIDNE20002660 | 544 | 1929 . . . 2249 | 2183 |
| KIDNE20003150 | 545 | 926 . . . 1306 | 2184 |
| KIDNE20003300 | 546 | 1205 . . . 2230 | 2185 |
| KIDNE20003490 | 547 | 219 . . . 1523 | 2186 |
| KIDNE20003750 | 548 | 732 . . . 1568 | 2187 |
| KIDNE20004030 | 549 | 194 . . . 3142 | 2188 |
| KIDNE20004220 | 550 | 1699 . . . 2217 | 2189 |
| KIDNE20004970 | 551 | 274 . . . 1479 | 2190 |
| KIDNE20005130 | 552 | 404 . . . 1417 | 2191 |
| KIDNE20005170 | 553 | 57 . . . 944 | 2192 |
| KIDNE20005190 | 554 | 530 . . . 1045 | 2193 |
| KIDNE20005740 | 555 | 32 . . . 1309 | 2194 |
| KIDNE20031850 | 556 | 1050 . . . >1998 | 2195 |
| KIDNE20033050 | 557 | 121 . . . 1719 | 2196 |
| KIDNE20033350 | 558 | 1999 . . . 2304 | 2197 |
| KIDNE20033570 | 559 | 269 . . . 634 | 2198 |
| KIDNE20033730 | 560 | 408 . . . 2366 | 2199 |
| KIDNE20033770 | 561 | 1256 . . . 1603 | 2200 |
| KIDNE20037520 | 562 | 1032 . . . 1637 | 2201 |
| KIDNE20039410 | 563 | 263 . . . 928 | 2202 |
| KIDNE20039940 | 564 | 133 . . . 1134 | 2203 |
| KIDNE20040340 | 565 | 460 . . . 768 | 2204 |
| KIDNE20040540 | 566 | 5 . . . 1276 | 2205 |
| KIDNE20040840 | 567 | 5 . . . >3343 | 2206 |
| KIDNE20042620 | 568 | 1312 . . . 1716 | 2207 |
| KIDNE20042940 | 569 | 213 . . . 611 | 2208 |
| KIDNE20042950 | 570 | 72 . . . 476 | 2209 |
| KIDNE20043440 | 571 | 49 . . . 2136 | 2210 |
| KIDNE20044110 | 572 | 167 . . . 1708 | 2211 |
| KIDNE20045200 | 573 | 1455 . . . 1955 | 2212 |
| KIDNE20045340 | 574 | 44 . . . 919 | 2213 |
| KIDNE20045790 | 575 | 1561 . . . 2085 | 2214 |
| KIDNE20046810 | 576 | 398 . . . 1066 | 2215 |
| KIDNE20048280 | 577 | 124 . . . 2010 | 2216 |
| KIDNE20048640 | 578 | 1437 . . . 1775 | 2217 |
| KIDNE20048790 | 579 | 348 . . . 701 | 2218 |
| KIDNE20049810 | 580 | 909 . . . 2108 | 2219 |
| KIDNE20050420 | 581 | 183 . . . 2351 | 2220 |
| KIDNE20052960 | 582 | 1105 . . . 1461 | 2221 |
| KIDNE20053360 | 583 | 1054 . . . 1470 | 2222 |
| KIDNE20054000 | 584 | 1246 . . . 1596 | 2223 |
| KIDNE20054770 | 585 | 99 . . . 1511 | 2224 |
| KIDNE20056290 | 586 | 398 . . . 1306 | 2225 |
| KIDNE20056760 | 587 | 375 . . . 1493 | 2226 |
| KIDNE20059080 | 588 | 44 . . . >2546 | 2227 |
| KIDNE20059370 | 589 | 1683 . . . 2018 | 2228 |
| KIDNE20060140 | 590 | 52 . . . 1572 | 2229 |
| KIDNE20060300 | 591 | 42 . . . 530 | 2230 |
| KIDNE20060530 | 592 | 136 . . . 2208 | 2231 |
| KIDNE20060620 | 593 | 31 . . . 687 | 2232 |
| KIDNE20061490 | 594 | 824 . . . 1327 | 2233 |
| KIDNE20062480 | 595 | 649 . . . 963 | 2234 |
| KIDNE20062990 | 596 | 72 . . . 1334 | 2235 |
| KIDNE20063530 | 597 | 710 . . . 1105 | 2236 |
| KIDNE20063760 | 598 | 1332 . . . 1724 | 2237 |
| KIDNE20066520 | 599 | 112 . . . 435 | 2238 |
| KIDNE20067600 | 600 | 677 . . . 1795 | 2239 |
| KIDNE20067750 | 601 | 54 . . . 2228 | 2240 |
| KIDNE20068800 | 602 | 1048 . . . 1473 | 2241 |
| KIDNE20070050 | 603 | 1672 . . . 2001 | 2242 |
| KIDNE20070770 | 604 | 610 . . . 1845 | 2243 |
| KIDNE20071860 | 605 | 1662 . . . 1973 | 2244 |
| KIDNE20073280 | 606 | 24 . . . 1898 | 2245 |
| KIDNE20073520 | 607 | 332 . . . 2140 | 2246 |
| KIDNE20073560 | 608 | 171 . . . 497 | 2247 |
| KIDNE20074220 | 609 | 1496 . . . 1879 | 2248 |
| KIDNE20075690 | 610 | 231 . . . 911 | 2249 |
| KIDNE20078100 | 611 | 714 . . . 1373 | 2250 |
| KIDNE20078110 | 612 | 166 . . . 1482 | 2251 |
| LIVER10000580 | 613 | 1704 . . . 2108 | 2252 |
| LIVER10000670 | 614 | 33 . . . 2063 | 2253 |
| LIVER10000790 | 615 | 98 . . . 1072 | 2254 |
| LIVER10000990 | 616 | 1451 . . . 2065 | 2255 |
| LIVER10001040 | 617 | 710 . . . 1759 | 2256 |
| LIVER10001110 | 618 | 549 . . . 878 | 2257 |
| LIVER10001750 | 619 | 1737 . . . 2156 | 2258 |
| LIVER10002300 | 620 | 861 . . . 1565 | 2259 |
| LIVER10002780 | 621 | 2235 . . . 2699 | 2260 |
| LIVER10003030 | 622 | 2310 . . . 2621 | 2261 |
| LIVER10004330 | 623 | 22 . . . 2130 | 2262 |
| LIVER10005420 | 624 | 131 . . . 2035 | 2263 |
| LIVER20000330 | 625 | 135 . . . 839 | 2264 |
| LIVER20000370 | 626 | 1158 . . . 2138 | 2265 |
| LIVER20004160 | 627 | 1625 . . . 1966 | 2266 |
| LIVER20004460 | 628 | 882 . . . 1307 | 2267 |
| LIVER20005150 | 629 | 1453 . . . 2262 | 2268 |
| MAMGL10000320 | 630 | 71 . . . 1792 | 2269 |
| MAMGL10000350 | 631 | 307 . . . 2721 | 2270 |
| MAMGL10000560 | 632 | 78 . . . 623 | 2271 |
| MAMGL10001780 | 633 | 1019 . . . 1618 | 2272 |
| MAMGL10001820 | 634 | 92 . . . 1405 | 2273 |
| MAMGL10001840 | 635 | 636 . . . 1181 | 2274 |
| MESAN10000350 | 636 | 362 . . . 1843 | 2275 |
| MESAN10001010 | 637 | 54 . . . 2279 | 2276 |
| MESAN10001470 | 638 | 1571 . . . 1906 | 2277 |
| MESAN10001800 | 639 | 482 . . . 1900 | 2278 |
| MESAN20000920 | 640 | 546 . . . 2213 | 2279 |
| MESAN20001490 | 641 | 652 . . . >2706 | 2280 |
| MESAN20002670 | 642 | 1092 . . . 1535 | 2281 |

TABLE 1-continued

| Clone name | SEQ ID NO. of nucleotide sequence | Position of CDS | SEQ ID NO. of amino acid sequence |
|---|---|---|---|
| MESAN20002910 | 643 | 1625 . . . 2269 | 2282 |
| MESAN20003370 | 644 | 198 . . . 521 | 2283 |
| MESAN20005010 | 645 | 183 . . . 1550 | 2284 |
| NB9N410000470 | 646 | 329 . . . >1714 | 2285 |
| NB9N410001210 | 647 | 74 . . . 1786 | 2286 |
| NB9N410001350 | 648 | 194 . . . 619 | 2287 |
| NB9N410001460 | 649 | 678 . . . 1136 | 2288 |
| NB9N420000420 | 650 | 596 . . . 928 | 2289 |
| NB9N420001040 | 651 | 12 . . . 2030 | 2290 |
| NB9N420004950 | 652 | 1929 . . . 2648 | 2291 |
| NESOP10000870 | 653 | 793 . . . 1554 | 2292 |
| NHNPC10000840 | 654 | 720 . . . >1934 | 2293 |
| NHNPC10001010 | 655 | 119 . . . 541 | 2294 |
| NHNPC10001240 | 656 | 1513 . . . 1860 | 2295 |
| NHNPC20002060 | 657 | 113 . . . 1351 | 2296 |
| NHNPC20002120 | 658 | 98 . . . 1195 | 2297 |
| NT2NE10000040 | 659 | 274 . . . 618 | 2298 |
| NT2NE10000140 | 660 | 232 . . . >2244 | 2299 |
| NT2NE10000180 | 661 | 131 . . . 1189 | 2300 |
| NT2NE10000230 | 662 | 172 . . . 483 | 2301 |
| NT2NE10000630 | 663 | 175 . . . 1317 | 2302 |
| NT2NE10000730 | 664 | 585 . . . 1364 | 2303 |
| NT2NE10000830 | 665 | 556 . . . 1179 | 2304 |
| NT2NE10001200 | 666 | 431 . . . 874 | 2305 |
| NT2NE10001630 | 667 | 600 . . . 1013 | 2306 |
| NT2NE10001850 | 668 | 23 . . . 1960 | 2307 |
| NT2NE20000380 | 669 | 408 . . . 962 | 2308 |
| NT2NE20000560 | 670 | 93 . . . >1858 | 2309 |
| NT2NE20000640 | 671 | 731 . . . 1063 | 2310 |
| NT2NE20001740 | 672 | 1 . . . 1638 | 2311 |
| NT2NE20002140 | 673 | 56 . . . 2053 | 2312 |
| NT2NE20002590 | 674 | 233 . . . 961 | 2313 |
| NT2NE20002990 | 675 | 117 . . . 1565 | 2314 |
| NT2NE20003270 | 676 | 127 . . . >2256 | 2315 |
| NT2NE20003690 | 677 | 534 . . . 893 | 2316 |
| NT2NE20003840 | 678 | 91 . . . 2403 | 2317 |
| NT2NE20003920 | 679 | 372 . . . 749 | 2318 |
| NT2NE20004550 | 680 | 31 . . . 852 | 2319 |
| NT2NE20004700 | 681 | 1569 . . . 2048 | 2320 |
| NT2NE20005170 | 682 | 217 . . . 990 | 2321 |
| NT2NE20005360 | 683 | 1412 . . . 1717 | 2322 |
| NT2NE20005500 | 684 | 574 . . . 1605 | 2323 |
| NT2NE20005860 | 685 | 289 . . . 996 | 2324 |
| NT2NE20006360 | 686 | 1383 . . . >2954 | 2325 |
| NT2NE20006580 | 687 | 937 . . . 2073 | 2326 |
| NT2NE20007060 | 688 | 640 . . . 1053 | 2327 |
| NT2NE20007630 | 689 | 11 . . . 679 | 2328 |
| NT2NE20007870 | 690 | 508 . . . 1092 | 2329 |
| NT2NE20008020 | 691 | 420 . . . 776 | 2330 |
| NT2NE20008090 | 692 | 328 . . . 1995 | 2331 |
| NT2NE20009800 | 693 | 547 . . . 1164 | 2332 |
| NT2NE20011560 | 694 | 78 . . . 1037 | 2333 |
| NT2NE20012470 | 695 | 204 . . . 614 | 2334 |
| NT2NE20013240 | 696 | 747 . . . 1079 | 2335 |
| NT2NE20013370 | 697 | 1229 . . . 2533 | 2336 |
| NT2NE20013640 | 698 | 1854 . . . 2264 | 2337 |
| NT2NE20013720 | 699 | 159 . . . 695 | 2338 |
| NT2NE20014030 | 700 | 1466 . . . 2263 | 2339 |
| NT2NE20014280 | 701 | 439 . . . 903 | 2340 |
| NT2NE20014350 | 702 | 684 . . . 1190 | 2341 |
| NT2NE20015300 | 703 | 120 . . . >2517 | 2342 |
| NT2NE20016230 | 704 | 713 . . . 1111 | 2343 |
| NT2NE20016260 | 705 | 528 . . . 1721 | 2344 |
| NT2NE20016340 | 706 | 575 . . . 1945 | 2345 |
| NT2NE20016480 | 707 | 5 . . . 388 | 2346 |
| NT2NE20016660 | 708 | 349 . . . 918 | 2347 |
| NT2NE20016970 | 709 | 48 . . . 566 | 2348 |
| NT2NE20034080 | 710 | 119 . . . 1606 | 2349 |
| NT2NE20035690 | 711 | 969 . . . >2204 | 2350 |
| NT2NE20044900 | 712 | 431 . . . 1039 | 2351 |
| NT2NE20047160 | 713 | 658 . . . 1707 | 2352 |
| NT2NE20053710 | 714 | 406 . . . 1020 | 2353 |
| NT2NE20054410 | 715 | 975 . . . 1715 | 2354 |
| NT2NE20055170 | 716 | 50 . . . 955 | 2355 |
| NT2NE20057200 | 717 | 205 . . . 879 | 2356 |
| NT2RI10000160 | 718 | 290 . . . 1270 | 2357 |
| NT2RI10000270 | 719 | 330 . . . 809 | 2358 |
| NT2RI10000480 | 720 | 502 . . . 1068 | 2359 |
| NT2RI10001640 | 721 | 4 . . . >2060 | 2360 |
| NT2RI20000640 | 722 | 1391 . . . 1894 | 2361 |
| NT2RI20002700 | 723 | 849 . . . 1253 | 2362 |
| NT2RI20002820 | 724 | 195 . . . 1781 | 2363 |
| NT2RI20002940 | 725 | 63 . . . 467 | 2364 |
| NT2RI20003410 | 726 | 148 . . . 1878 | 2365 |
| NT2RI20004120 | 727 | 23 . . . 1600 | 2366 |
| NT2RI20004210 | 728 | 477 . . . 1367 | 2367 |
| NT2RI20005970 | 729 | 309 . . . 1562 | 2368 |
| NT2RI20006690 | 730 | 206 . . . >2507 | 2369 |
| NT2RI20006710 | 731 | 884 . . . 1654 | 2370 |
| NT2RI20006850 | 732 | 550 . . . 2235 | 2371 |
| NT2RI20007380 | 733 | 843 . . . 1208 | 2372 |
| NT2RI20008650 | 734 | 692 . . . 1045 | 2373 |
| NT2RI20009740 | 735 | 287 . . . 595 | 2374 |
| NT2RI20010100 | 736 | 150 . . . 1727 | 2375 |
| NT2RI20010830 | 737 | 295 . . . 2325 | 2376 |
| NT2RI20010910 | 738 | 361 . . . 1254 | 2377 |
| NT2RI20012350 | 739 | 969 . . . 1331 | 2378 |
| NT2RI20012440 | 740 | 1026 . . . 1367 | 2379 |
| NT2RI20013420 | 741 | 6 . . . 506 | 2380 |
| NT2RI20013850 | 742 | 838 . . . 1497 | 2381 |
| NT2RI20014090 | 743 | 57 . . . 1739 | 2382 |
| NT2RI20014100 | 744 | 1280 . . . 1612 | 2383 |
| NT2RI20014490 | 745 | 244 . . . 2247 | 2384 |
| NT2RI20014500 | 746 | 451 . . . 2331 | 2385 |
| NT2RI20015190 | 747 | 388 . . . 1671 | 2386 |
| NT2RI20015400 | 748 | 454 . . . 2277 | 2387 |
| NT2RI20015950 | 749 | 575 . . . 1078 | 2388 |
| NT2RI20016210 | 750 | 571 . . . 1113 | 2389 |
| NT2RI20016570 | 751 | 238 . . . 1026 | 2390 |
| NT2RI20017260 | 752 | 1143 . . . 1703 | 2391 |
| NT2RI20018460 | 753 | 64 . . . >2603 | 2392 |
| NT2RI20018660 | 754 | 245 . . . 1672 | 2393 |
| NT2RI20020220 | 755 | 571 . . . 1485 | 2394 |
| NT2RI20020410 | 756 | 398 . . . 850 | 2395 |
| NT2RI20021520 | 757 | 505 . . . 1482 | 2396 |
| NT2RI20022430 | 758 | 1 . . . 1350 | 2397 |
| NT2RI20022520 | 759 | 1165 . . . 1629 | 2398 |
| NT2RI20022700 | 760 | 532 . . . 1401 | 2399 |
| NT2RI20025170 | 761 | 90 . . . 1727 | 2400 |
| NT2RI20025300 | 762 | 570 . . . >2759 | 2401 |
| NT2RI20025410 | 763 | 15 . . . 1757 | 2402 |
| NT2RI20025540 | 764 | 170 . . . >2080 | 2403 |
| NT2RI20025850 | 765 | 245 . . . 1816 | 2404 |
| NT2RI20026540 | 766 | 191 . . . 1555 | 2405 |
| NT2RI20028020 | 767 | 1 . . . 420 | 2406 |
| NT2RI20028520 | 768 | 120 . . . 692 | 2407 |
| NT2RI20029260 | 769 | 1253 . . . 1714 | 2408 |
| NT2RI20029580 | 770 | 350 . . . 2023 | 2409 |
| NT2RI20029700 | 771 | 312 . . . 881 | 2410 |
| NT2RI20030110 | 772 | 248 . . . 862 | 2411 |
| NT2RI20030190 | 773 | 43 . . . 357 | 2412 |
| NT2RI20030510 | 774 | 1317 . . . 1715 | 2413 |
| NT2RI20030670 | 775 | 714 . . . 1046 | 2414 |
| NT2RI20031540 | 776 | 84 . . . 1538 | 2415 |
| NT2RI20032050 | 777 | 698 . . . 2797 | 2416 |
| NT2RI20032220 | 778 | 640 . . . >2800 | 2417 |
| NT2RI20033010 | 779 | 652 . . . 2898 | 2418 |
| NT2RI20033040 | 780 | 408 . . . 794 | 2419 |
| NT2RI20033380 | 781 | 121 . . . 1374 | 2420 |
| NT2RI20033440 | 782 | 650 . . . 1687 | 2421 |
| NT2RI20033830 | 783 | 165 . . . 929 | 2422 |
| NT2RI20035560 | 784 | 27 . . . 1883 | 2423 |
| NT2RI20036780 | 785 | 513 . . . 2585 | 2424 |
| NT2RI20036950 | 786 | 355 . . . 2445 | 2425 |
| NT2RI20037510 | 787 | 591 . . . 1589 | 2426 |
| NT2RI20040590 | 788 | 605 . . . 1597 | 2427 |
| NT2RI20041900 | 789 | 86 . . . 442 | 2428 |
| NT2RI20042840 | 790 | 760 . . . 1083 | 2429 |
| NT2RI20043040 | 791 | 236 . . . 1867 | 2430 |
| NT2RI20043980 | 792 | 76 . . . 549 | 2431 |

TABLE 1-continued

| Clone name | SEQ ID NO. of nucleotide sequence | Position of CDS | SEQ ID NO. of amino acid sequence | Clone name | SEQ ID NO. of nucleotide sequence | Position of CDS | SEQ ID NO. of amino acid sequence |
|---|---|---|---|---|---|---|---|
| NT2RI20044420 | 793 | 1080 . . . 1454 | 2432 | NT2RI20089420 | 868 | 626 . . . 1099 | 2507 |
| NT2RI20046060 | 794 | 782 . . . 1480 | 2433 | NT2RI20090650 | 869 | 41 . . . 1594 | 2508 |
| NT2RI20047830 | 795 | 297 . . . 623 | 2434 | NT2RI20090660 | 870 | 65 . . . 1852 | 2509 |
| NT2RI20048400 | 796 | 16 . . . 324 | 2435 | NT2RI20090830 | 871 | 988 . . . 1713 | 2510 |
| NT2RI20049160 | 797 | 668 . . . 1054 | 2436 | NT2RI20091440 | 872 | 216 . . . 1037 | 2511 |
| NT2RI20049840 | 798 | 1266 . . . 2060 | 2437 | NT2RI20092150 | 873 | 574 . . . >2918 | 2512 |
| NT2RI20049850 | 799 | 783 . . . 1973 | 2438 | NT2RI20092890 | 874 | 651 . . . 2471 | 2513 |
| NT2RI20050610 | 800 | 19 . . . 2301 | 2439 | NT2RI20094060 | 875 | 17 . . . 1030 | 2514 |
| NT2RI20050870 | 801 | 101 . . . 2056 | 2440 | NT2RP60000080 | 876 | 2249 . . . 2614 | 2515 |
| NT2RI20051500 | 802 | 236 . . . 1246 | 2441 | NT2RP60000170 | 877 | 128 . . . 928 | 2516 |
| NT2RI20053350 | 803 | 128 . . . 2125 | 2442 | NT2RP60000320 | 878 | 27 . . . 2108 | 2517 |
| NT2RI20053680 | 804 | 310 . . . >2430 | 2443 | NT2RP60000350 | 879 | 553 . . . 1734 | 2518 |
| NT2RI20055640 | 805 | 68 . . . 1171 | 2444 | NT2RP60000390 | 880 | 455 . . . 829 | 2519 |
| NT2RI20056280 | 806 | 1493 . . . 1954 | 2445 | NT2RP60000590 | 881 | 2067 . . . 2381 | 2520 |
| NT2RI20056470 | 807 | 272 . . . 2098 | 2446 | NT2RP60000720 | 882 | 1136 . . . 2104 | 2521 |
| NT2RI20057230 | 808 | 118 . . . >1116 | 2447 | NT2RP60000860 | 883 | 7 . . . 660 | 2522 |
| NT2RI20058110 | 809 | 145 . . . 1566 | 2448 | NT2RP60001000 | 884 | 474 . . . 1694 | 2523 |
| NT2RI20058510 | 810 | 107 . . . 2050 | 2449 | NT2RP60001090 | 885 | 442 . . . 2136 | 2524 |
| NT2RI20060710 | 811 | 274 . . . 1278 | 2450 | NT2RP60001230 | 886 | 78 . . . 1937 | 2525 |
| NT2RI20060720 | 812 | 78 . . . 2354 | 2451 | NT2RP60001270 | 887 | 858 . . . 1652 | 2526 |
| NT2RI20061270 | 813 | 14 . . . 352 | 2452 | NT2RP70000410 | 888 | 801 . . . 1103 | 2527 |
| NT2RI20061830 | 814 | 906 . . . 1580 | 2453 | NT2RP70000690 | 889 | 259 . . . 3270 | 2528 |
| NT2RI20062100 | 815 | 1465 . . . 2487 | 2454 | NT2RP70000760 | 890 | 954 . . . 1295 | 2529 |
| NT2RI20063450 | 816 | 278 . . . 745 | 2455 | NT2RP70002380 | 891 | 231 . . . 1208 | 2530 |
| NT2RI20064120 | 817 | 281 . . . 1321 | 2456 | NT2RP70002590 | 892 | 202 . . . 993 | 2531 |
| NT2RI20064870 | 818 | 647 . . . 1138 | 2457 | NT2RP70002710 | 893 | 264 . . . 1619 | 2532 |
| NT2RI20065060 | 819 | 63 . . . 1193 | 2458 | NT2RP70003640 | 894 | 2617 . . . 2994 | 2533 |
| NT2RI20065530 | 820 | 644 . . . 1135 | 2459 | NT2RP70003910 | 895 | 1492 . . . 1797 | 2534 |
| NT2RI20066670 | 821 | 23 . . . 598 | 2460 | NT2RP70004250 | 896 | 261 . . . 1115 | 2535 |
| NT2RI20066790 | 822 | 272 . . . 1747 | 2461 | NT2RP70004770 | 897 | 1132 . . . 2541 | 2536 |
| NT2RI20066820 | 823 | 145 . . . 1173 | 2462 | NT2RP70005790 | 898 | 940 . . . 1257 | 2537 |
| NT2RI20067030 | 824 | 58 . . . 1368 | 2463 | NT2RP70006240 | 899 | 26 . . . 1756 | 2538 |
| NT2RI20067350 | 825 | 100 . . . >2451 | 2464 | NT2RP70008120 | 900 | 90 . . . 476 | 2539 |
| NT2RI20067880 | 826 | 25 . . . 732 | 2465 | NT2RP70009060 | 901 | 2197 . . . 3105 | 2540 |
| NT2RI20068250 | 827 | 123 . . . 2246 | 2466 | NT2RP70010800 | 902 | 132 . . . 2060 | 2541 |
| NT2RI20068550 | 828 | 250 . . . 1656 | 2467 | NT2RP70011660 | 903 | 5 . . . 3619 | 2542 |
| NT2RI20070480 | 829 | 483 . . . 1844 | 2468 | NT2RP70012310 | 904 | 8 . . . 1756 | 2543 |
| NT2RI20070840 | 830 | 25 . . . 600 | 2469 | NT2RP70013060 | 905 | 1533 . . . 2693 | 2544 |
| NT2RI20070960 | 831 | 212 . . . >2749 | 2470 | NT2RP70013350 | 906 | 396 . . . 2096 | 2545 |
| NT2RI20071160 | 832 | 921 . . . 1643 | 2471 | NT2RP70015910 | 907 | 14 . . . 1492 | 2546 |
| NT2RI20071330 | 833 | 159 . . . 2105 | 2472 | NT2RP70018560 | 908 | 167 . . . 1561 | 2547 |
| NT2RI20071480 | 834 | 82 . . . 1155 | 2473 | NT2RP70021510 | 909 | 209 . . . 538 | 2548 |
| NT2RI20072140 | 835 | 845 . . . 1192 | 2474 | NT2RP70022430 | 910 | 269 . . . 2617 | 2549 |
| NT2RI20072540 | 836 | 483 . . . 1394 | 2475 | NT2RP70023760 | 911 | 92 . . . 3292 | 2550 |
| NT2RI20073030 | 837 | 914 . . . 1351 | 2476 | NT2RP70023790 | 912 | 1022 . . . 2797 | 2551 |
| NT2RI20073840 | 838 | 202 . . . 1569 | 2477 | NT2RP70024490 | 913 | 223 . . . 888 | 2552 |
| NT2RI20073860 | 839 | 150 . . . 506 | 2478 | NT2RP70024500 | 914 | 333 . . . 1652 | 2553 |
| NT2RI20074390 | 840 | 60 . . . 1916 | 2479 | NT2RP70025540 | 915 | 191 . . . 532 | 2554 |
| NT2RI20074690 | 841 | 430 . . . >2130 | 2480 | NT2RP70026190 | 916 | 1277 . . . >3059 | 2555 |
| NT2RI20074890 | 842 | 175 . . . 1269 | 2481 | NT2RP70028290 | 917 | 52 . . . 2169 | 2556 |
| NT2RI20075070 | 843 | 1064 . . . 1513 | 2482 | NT2RP70028410 | 918 | 363 . . . 983 | 2557 |
| NT2RI20075720 | 844 | 193 . . . 1758 | 2483 | NT2RP70028750 | 919 | 69 . . . 1226 | 2558 |
| NT2RI20075890 | 845 | 927 . . . 1520 | 2484 | NT2RP70029060 | 920 | 283 . . . 2847 | 2559 |
| NT2RI20077230 | 846 | 79 . . . 741 | 2485 | NT2RP70029820 | 921 | 199 . . . 2325 | 2560 |
| NT2RI20077290 | 847 | 101 . . . 793 | 2486 | NT2RP70030500 | 922 | 58 . . . 480 | 2561 |
| NT2RI20077510 | 848 | 455 . . . 766 | 2487 | NT2RP70030550 | 923 | 148 . . . 1854 | 2562 |
| NT2RI20077540 | 849 | 527 . . . 1075 | 2488 | NT2RP70030910 | 924 | 2186 . . . 2785 | 2563 |
| NT2RI20078270 | 850 | 61 . . . 717 | 2489 | NT2RP70032030 | 925 | 214 . . . 1584 | 2564 |
| NT2RI20078790 | 851 | 391 . . . 1020 | 2490 | NT2RP70033040 | 926 | 294 . . . 1166 | 2565 |
| NT2RI20078840 | 852 | 635 . . . 2410 | 2491 | NT2RP70036290 | 927 | 490 . . . 2808 | 2566 |
| NT2RI20078910 | 853 | 334 . . . 1524 | 2492 | NT2RP70036320 | 928 | 550 . . . 1002 | 2567 |
| NT2RI20080500 | 854 | 229 . . . 1767 | 2493 | NT2RP70036470 | 929 | 340 . . . 3312 | 2568 |
| NT2RI20081880 | 855 | 158 . . . 1180 | 2494 | NT2RP70036800 | 930 | 151 . . . 2307 | 2569 |
| NT2RI20082210 | 856 | 449 . . . 1120 | 2495 | NT2RP70039600 | 931 | 254 . . . 3121 | 2570 |
| NT2RI20083360 | 857 | 60 . . . 1898 | 2496 | NT2RP70040800 | 932 | 592 . . . 1587 | 2571 |
| NT2RI20083960 | 858 | 164 . . . 919 | 2497 | NT2RP70042040 | 933 | 855 . . . 1946 | 2572 |
| NT2RI20084810 | 859 | 863 . . . 1384 | 2498 | NT2RP70042330 | 934 | 434 . . . 2908 | 2573 |
| NT2RI20085260 | 860 | 347 . . . 709 | 2499 | NT2RP70042600 | 935 | 428 . . . 2539 | 2574 |
| NT2RI20085980 | 861 | 357 . . . >2020 | 2500 | NT2RP70043730 | 936 | 312 . . . 2828 | 2575 |
| NT2RI20086560 | 862 | 478 . . . 798 | 2501 | NT2RP70043960 | 937 | 17 . . . 3181 | 2576 |
| NT2RI20087140 | 863 | 108 . . . 443 | 2502 | NT2RP70045410 | 938 | 82 . . . >3154 | 2577 |
| NT2RI20087490 | 864 | 498 . . . 1862 | 2503 | NT2RP70046560 | 939 | 41 . . . 2593 | 2578 |
| NT2RI20087910 | 865 | 508 . . . 1011 | 2504 | NT2RP70046870 | 940 | 47 . . . 2995 | 2579 |
| NT2RI20088010 | 866 | 316 . . . 759 | 2505 | NT2RP70047510 | 941 | 29 . . . 394 | 2580 |
| NT2RI20088120 | 867 | 10 . . . 684 | 2506 | NT2RP70047660 | 942 | 958 . . . 1332 | 2581 |

TABLE 1-continued

| Clone name | SEQ ID NO. of nucleotide sequence | Position of CDS | SEQ ID NO. of amino acid sequence |
|---|---|---|---|
| NT2RP70047900 | 943 | 1553 ... 1870 | 2582 |
| NT2RP70049150 | 944 | 436 ... 2349 | 2583 |
| NT2RP70049250 | 945 | 100 ... 1356 | 2584 |
| NT2RP70049750 | 946 | 1483 ... 2013 | 2585 |
| NT2RP70052050 | 947 | 2014 ... 2481 | 2586 |
| NT2RP70052190 | 948 | 24 ... 413 | 2587 |
| NT2RP70054680 | 949 | 1192 ... 1563 | 2588 |
| NT2RP70054930 | 950 | 214 ... 579 | 2589 |
| NT2RP70055020 | 951 | 774 ... 1142 | 2590 |
| NT2RP70055130 | 952 | 175 ... 1791 | 2591 |
| NT2RP70055200 | 953 | 1388 ... 1879 | 2592 |
| NT2RP70061620 | 954 | 1241 ... 2518 | 2593 |
| NT2RP70061880 | 955 | 161 ... >3222 | 2594 |
| NT2RP70062960 | 956 | 604 ... 3786 | 2595 |
| NT2RP70063040 | 957 | 277 ... 1701 | 2596 |
| NT2RP70063740 | 958 | 525 ... 908 | 2597 |
| NT2RP70064080 | 959 | 189 ... 974 | 2598 |
| NT2RP70064900 | 960 | 74 ... 2332 | 2599 |
| NT2RP70065270 | 961 | 261 ... 2756 | 2600 |
| NT2RP70066210 | 962 | 1294 ... 1926 | 2601 |
| NT2RP70067010 | 963 | 342 ... 662 | 2602 |
| NT2RP70069800 | 964 | 1520 ... 1972 | 2603 |
| NT2RP70069860 | 965 | 132 ... 1964 | 2604 |
| NT2RP70071140 | 966 | 1812 ... 2342 | 2605 |
| NT2RP70071540 | 967 | 694 ... 1776 | 2606 |
| NT2RP70071770 | 968 | 28 ... 2103 | 2607 |
| NT2RP70072210 | 969 | 205 ... 1944 | 2608 |
| NT2RP70072520 | 970 | 79 ... >3136 | 2609 |
| NT2RP70073590 | 971 | 213.3 ... 2525 | 2610 |
| NT2RP70073810 | 972 | 171 ... 683 | 2611 |
| NT2RP70074060 | 973 | 248 ... 739 | 2612 |
| NT2RP70074220 | 974 | 367 ... 726 | 2613 |
| NT2RP70075040 | 975 | 365 ... >3111 | 2614 |
| NT2RP70075370 | 976 | 253 ... 1710 | 2615 |
| NT2RP70076100 | 977 | 280 ... 2415 | 2616 |
| NT2RP70076170 | 978 | 74 ... 1717 | 2617 |
| NT2RP70076430 | 979 | 461 ... 2788 | 2618 |
| NT2RP70079250 | 980 | 365 ... 3256 | 2619 |
| NT2RP70079300 | 981 | 240 ... 554 | 2620 |
| NT2RP70079750 | 982 | 954 ... 2867 | 2621 |
| NT2RP70081330 | 983 | 187 ... 1458 | 2622 |
| NT2RP70081370 | 984 | 279 ... 2876 | 2623 |
| NT2RP70081420 | 985 | 1246 ... 1719 | 2624 |
| NT2RP70081440 | 986 | 1013 ... 1501 | 2625 |
| NT2RP70081670 | 987 | 47 ... 3034 | 2626 |
| NT2RP70083150 | 988 | 118 ... >3979 | 2627 |
| NT2RP70084060 | 989 | 47 ... 847 | 2628 |
| NT2RP70084410 | 990 | 115 ... >3256 | 2629 |
| NT2RP70084870 | 991 | 70 ... 1422 | 2630 |
| NT2RP70085500 | 992 | 170 ... 3274 | 2631 |
| NT2RP70085570 | 993 | 302 ... 2035 | 2632 |
| NT2RP70086230 | 994 | 799 ... 1203 | 2633 |
| NT2RP70087200 | 995 | 211 ... 2583 | 2634 |
| NT2RP70088550 | 996 | 57 ... 1529 | 2635 |
| NT2RP70090120 | 997 | 52 ... 2397 | 2636 |
| NT2RP70090190 | 998 | 1358 ... 2545 | 2637 |
| NT2RP70091490 | 999 | 18 ... 764 | 2638 |
| NT2RP70091680 | 1000 | 2064 ... 2618 | 2639 |
| NT2RP70092150 | 1001 | 5 ... 481 | 2640 |
| NT2RP70092360 | 1002 | 116 ... >3870 | 2641 |
| NT2RP70092590 | 1003 | 148 ... 2256 | 2642 |
| NT2RP70093220 | 1004 | 333 ... 2783 | 2643 |
| NT2RP70093630 | 1005 | 1372 ... 1710 | 2644 |
| NT2RP70093700 | 1006 | 124 ... 2220 | 2645 |
| NT2RP70093730 | 1007 | 212 ... 2389 | 2646 |
| NT2RP70093940 | 1008 | 135 ... 2909 | 2647 |
| NT2RP70093970 | 1009 | 830 ... 1705 | 2648 |
| NT2RP70094290 | 1010 | 705 ... 1046 | 2649 |
| NT2RP70094660 | 1011 | 76 ... 393 | 2650 |
| NT2RP70094810 | 1012 | 94 ... 3705 | 2651 |
| NT2RP70094980 | 1013 | 38 ... 2905 | 2652 |
| NT2RP70095020 | 1014 | 2451 ... 2768 | 2653 |
| NT2RP70095070 | 1015 | 228 ... 638 | 2654 |
| NTONG10000330 | 1016 | 9 ... 2423 | 2655 |
| NTONG10000520 | 1017 | 83 ... 1501 | 2656 |
| NTONG10000980 | 1018 | 576 ... 1703 | 2657 |
| NTONG10001230 | 1019 | 318 ... 1967 | 2658 |
| NTONG10001300 | 1020 | 223 ... 1839 | 2659 |
| NTONG10001820 | 1021 | 677 ... 1558 | 2660 |
| NTONG10002140 | 1022 | 14 ... 1207 | 2661 |
| NTONG10002460 | 1023 | 242 ... 1561 | 2662 |
| NTONG10002570 | 1024 | 107 ... 658 | 2663 |
| NTONG10002640 | 1025 | 263 ... 2131 | 2664 |
| NTONG20002650 | 1026 | 177 ... 2696 | 2665 |
| NTONG20003340 | 1027 | 322 ... 996 | 2666 |
| NTONG20003630 | 1028 | 183 ... >2114 | 2667 |
| NTONG20004920 | 1029 | 1693 ... 1998 | 2668 |
| NTONG20005830 | 1030 | 268 ... 624 | 2669 |
| NTONG20008000 | 1031 | 160 ... 1503 | 2670 |
| NTONG20008780 | 1032 | 264 ... 1829 | 2671 |
| NTONG20009660 | 1033 | 12 ... 1199 | 2672 |
| NTONG20009850 | 1034 | 32 ... 388 | 2673 |
| NTONG20011370 | 1035 | 123 ... 440 | 2674 |
| NTONG20012220 | 1036 | 109 ... 447 | 2675 |
| NTONG20014280 | 1037 | 47 ... 367 | 2676 |
| NTONG20015500 | 1038 | 388 ... 1416 | 2677 |
| NTONG20016120 | 1039 | 27 ... 2267 | 2678 |
| OCBBF10000420 | 1040 | 457 ... 894 | 2679 |
| OCBBF10000670 | 1041 | 694 ... 1149 | 2680 |
| OCBBF10000860 | 1042 | 1 ... 465 | 2681 |
| OCBBF10000910 | 1043 | 397 ... 3999 | 2682 |
| OCBBF10001040 | 1044 | 869 ... 1288 | 2683 |
| OCBBF10001180 | 1045 | 108 ... 977 | 2684 |
| OCBBF10001190 | 1046 | 171 ... 2444 | 2685 |
| OCBBF10001220 | 1047 | 235 ... 2259 | 2686 |
| OCBBF20000130 | 1048 | 211 ... 2301 | 2687 |
| OGBBF20001260 | 1049 | 1733 ... 2107 | 2688 |
| OCBBF20002310 | 1050 | 302 ... 1870 | 2689 |
| OCBBF20002770 | 1051 | 19 ... 1374 | 2690 |
| OCBBF20002870 | 1052 | 1874 ... >2191 | 2691 |
| OCBBF20007190 | 1053 | 457 ... 2277 | 2692 |
| OGBBF20008240 | 1054 | 46 ... 2169 | 2693 |
| OCBBF20009040 | 1055 | 273 ... 2030 | 2694 |
| OCBBF20009980 | 1056 | 152 ... 526 | 2695 |
| OCBBF20010750 | 1057 | 221 ... 655 | 2696 |
| OCBBF20011010 | 1058 | 1 ... 1323 | 2697 |
| OCBBF20011240 | 1059 | 313 ... >2823 | 2698 |
| OCBBF20011400 | 1060 | 144 ... >3731 | 2699 |
| OCBBF20011760 | 1061 | 139 ... 1815 | 2700 |
| OCBBF20012100 | 1062 | 107 ... 1840 | 2701 |
| OCBBF20013070 | 1063 | 177 ... 1199 | 2702 |
| OCBBF20014020 | 1064 | 174 ... >2999 | 2703 |
| OCBBF20014080 | 1065 | 80 ... 646 | 2704 |
| OCBBF20014940 | 1066 | 160 ... 3648 | 2705 |
| OCBBF20015270 | 1067 | 539 ... >2338 | 2706 |
| OCBBF20015280 | 1068 | 79 ... >2727 | 2707 |
| OCBBF20015860 | 1069 | 201 ... 827 | 2708 |
| OCBBF20017060 | 1070 | 1065 ... 1463 | 2709 |
| PANCR10000210 | 1071 | 42 ... 863 | 2710 |
| PANCR10001850 | 1072 | 77 ... 379 | 2711 |
| PEBLM10000290 | 1073 | 1294 ... 1722 | 2712 |
| PEBLM10000340 | 1074 | 12 ... 1814 | 2713 |
| PEBLM10000680 | 1075 | 1330 ... 1923 | 2714 |
| PEBLM10001440 | 1076 | 154 ... 2799 | 2715 |
| PEBLM10001800 | 1077 | 1072 ... 1509 | 2716 |
| PEBLM20000300 | 1078 | 1538 ... 2563 | 2717 |
| PEBLM20001120 | 1079 | 175 ... 2934 | 2718 |
| PEBLM20001260 | 1080 | 2535 ... 2918 | 2719 |
| PEBLM20001470 | 1081 | 306 ... 698 | 2720 |
| PEBLM20002130 | 1082 | 35 ... 979 | 2721 |
| PEBLM20002480 | 1083 | 162 ... 1334 | 2722 |
| PEBLM20002700 | 1084 | 170 ... 1762 | 2723 |
| PEBLM20003080 | 1085 | 669 ... 1685 | 2724 |
| PEBLM20003950 | 1086 | 285 ... 881 | 2725 |
| PEBLM20004790 | 1087 | 341 ... 1798 | 2726 |
| PLACE50000370 | 1088 | 986 ... 1912 | 2727 |
| PLACE50000580 | 1089 | 387 ... 3224 | 2728 |
| PLACE50000670 | 1090 | 2506 ... 2874 | 2729 |
| PLACE50000680 | 1091 | 407 ... 2119 | 2730 |
| PLACE50000800 | 1092 | 488 ... >3266 | 2731 |

TABLE 1-continued

| Clone name | SEQ ID NO. of nucleotide sequence | Position of CDS | SEQ ID NO. of amino acid sequence |
|---|---|---|---|
| PLACE50001050 | 1093 | 417 . . . 2234 | 2732 |
| PLACE50001130 | 1094 | 12 . . . 4397 | 2733 |
| PLACE50001530 | 1095 | 1874 . . . 2224 | 2734 |
| PLACE50001700 | 1096 | 80 . . . 2140 | 2735 |
| PLACE60000440 | 1097 | 1255 . . . 1575 | 2736 |
| PLACE60000700 | 1098 | 250 . . . 684 | 2737 |
| PLACE60000800 | 1099 | 1570 . . . 1995 | 2738 |
| PLACE60001370 | 1100 | 1126 . . . 1521 | 2739 |
| PLACE60002050 | 1101 | 243 . . . 1175 | 2740 |
| PLACE60002630 | 1102 | 1574 . . . 2191 | 2741 |
| PLACE60003710 | 1103 | 1170 . . . 1517 | 2742 |
| PLACE60003790 | 1104 | 908 . . . 1564 | 2743 |
| PLACE60004240 | 1105 | 243 . . . 845 | 2744 |
| PLACE60004290 | 1106 | 1792 . . . 2154 | 2745 |
| PLACE60005230 | 1107 | 449 . . . 994 | 2746 |
| PLACE60005500 | 1108 | 447 . . . 791 | 2747 |
| PLACE60005550 | 1109 | 140 . . . 631 | 2748 |
| PLACE60009530 | 1110 | 8 . . . 337 | 2749 |
| PLACE60012810 | 1111 | 76 . . . 2601 | 2750 |
| PLACE60012940 | 1112 | 159 . . . 587 | 2751 |
| PLACE60014430 | 1113 | 215 . . . 1816 | 2752 |
| PLACE60018860 | 1114 | 94 . . . 1614 | 2753 |
| PLACE60019230 | 1115 | 174 . . . 524 | 2754 |
| PLACE60019250 | 1116 | 1562 . . . >2068 | 2755 |
| PLACE60020160 | 1117 | 41 . . . 412 | 2756 |
| PLACE60020840 | 1118 | 654 . . . 1382 | 2757 |
| PLACE60021020 | 1119 | 106 . . . 600 | 2758 |
| PLACE60021510 | 1120 | 261 . . . 1871 | 2759 |
| PLACE60024190 | 1121 | 15 . . . 1145 | 2760 |
| PLACE60026680 | 1122 | 332 . . . 1924 | 2761 |
| PLACE60026920 | 1123 | 1 . . . 333 | 2762 |
| PLACE60026990 | 1124 | 39 . . . 836 | 2763 |
| PLACE60029400 | 1125 | 130 . . . 477 | 2764 |
| PLACE60030380 | 1126 | 28 . . . 1149 | 2765 |
| PLACE60030940 | 1127 | 61 . . . 720 | 2766 |
| PLACE60031090 | 1128 | 650 . . . 1270 | 2767 |
| PLACE60032040 | 1129 | 110 . . . 448 | 2768 |
| PLACE60033720 | 1130 | 595 . . . 1053 | 2769 |
| PLACE60033990 | 1131 | 403 . . . 1173 | 2770 |
| PLACE60037050 | 1132 | 485 . . . 1159 | 2771 |
| PLACE60037400 | 1133 | 597 . . . 923 | 2772 |
| PLACE60037450 | 1134 | 112 . . . 558 | 2773 |
| PLACE60038500 | 1135 | 734 . . . 1264 | 2774 |
| PLACE60040050 | 1136 | 15 . . . 599 | 2775 |
| PLACE60043120 | 1137 | 162 . . . 731 | 2776 |
| PLACE60043360 | 1138 | 1899 . . . 2225 | 2777 |
| PLACE60043960 | 1139 | 129 . . . 1754 | 2778 |
| PLACE60043970 | 1140 | 208 . . . 1842 | 2779 |
| PLACE60044540 | 1141 | 22 . . . >2582 | 2780 |
| PLACE60044640 | 1142 | 319 . . . 2100 | 2781 |
| PLACE60044910 | 1143 | 1249 . . . 1572 | 2782 |
| PLACE60046630 | 1144 | 1108 . . . 1620 | 2783 |
| PLACE60046870 | 1145 | 37 . . . 471 | 2784 |
| PLACE60047380 | 1146 | 384 . . . 1250 | 2785 |
| PLACE60049310 | 1147 | 18 . . . 320 | 2786 |
| PLACE60049930 | 1148 | 1324 . . . 1641 | 2787 |
| PLACE60050290 | 1149 | 220 . . . 606 | 2788 |
| PROST10001520 | 1150 | 1847 . . . 2149 | 2789 |
| PROST10001670 | 1151 | 608 . . . 1660 | 2790 |
| PROST10002200 | 1152 | 137 . . . 988 | 2791 |
| PROST10002460 | 1153 | 1240 . . . 1713 | 2792 |
| PROST10002720 | 1154 | 114 . . . 689 | 2793 |
| PROST10003430 | 1155 | 259 . . . 2445 | 2794 |
| PROST10005260 | 1156 | 1214 . . . 1591 | 2795 |
| PROST10005360 | 1157 | 240 . . . 2477 | 2796 |
| PROST10005640 | 1158 | 139 . . . 525 | 2797 |
| PROST20000360 | 1159 | 1580 . . . 1969 | 2798 |
| PROST20000530 | 1160 | 1439 . . . 1825 | 2799 |
| PROST20001760 | 1161 | 44 . . . 1276 | 2800 |
| PROST20002060 | 1162 | 1072 . . . 1506 | 2801 |
| PROST20002670 | 1163 | 547 . . . 897 | 2802 |
| PROST20002730 | 1164 | 1070 . . . 1477 | 2803 |
| PROST20002740 | 1165 | 1557 . . . 1910 | 2804 |
| PROST20003250 | 1166 | 96 . . . 965 | 2805 |
| PROST20004630 | 1167 | 495 . . . 815 | 2806 |
| PROST20017390 | 1168 | 122 . . . 505 | 2807 |
| PROST20017960 | 1169 | 1401 . . . 1829 | 2808 |
| PROST20018230 | 1170 | 89 . . . 1447 | 2809 |
| PROST20018990 | 1171 | 2024 . . . 2953 | 2810 |
| PROST20019980 | 1172 | 1544 . . . 1852 | 2811 |
| PROST20021620 | 1173 | 1439 . . . 1918 | 2812 |
| PROST20023380 | 1174 | 11 . . . 559 | 2813 |
| PROST20025910 | 1175 | 94 . . . 408 | 2814 |
| PROST20026820 | 1176 | 411 . . . 1511 | 2815 |
| PROST20028420 | 1177 | 1173 . . . 1607 | 2816 |
| PROST20029600 | 1178 | 245 . . . 856 | 2817 |
| PROST20031020 | 1179 | 20 . . . 1456 | 2818 |
| PROST20031170 | 1180 | 163 . . . 1578 | 2819 |
| PROST20032100 | 1181 | 82 . . . 1671 | 2820 |
| PROST20032320 | 1182 | 2537 . . . 3004 | 2821 |
| PROST20033020 | 1183 | 1550 . . . 1906 | 2822 |
| PROST20033030 | 1184 | 247 . . . 567 | 2823 |
| PROST20033380 | 1185 | 19 . . . 1524 | 2824 |
| PROST20033400 | 1186 | 294 . . . 647 | 2825 |
| PROST20034720 | 1187 | 280 . . . 1764 | 2826 |
| PROST20037320 | 1188 | 1001 . . . 1414 | 2827 |
| PROST20039220 | 1189 | 1790 . . . 2416 | 2828 |
| PROST20043320 | 1190 | 278 . . . 1843 | 2829 |
| PROST20044160 | 1191 | 435 . . . 866 | 2830 |
| PROST20044810 | 1192 | 1442 . . . 1759 | 2831 |
| PROST20051210 | 1193 | 405 . . . 1217 | 2832 |
| PROST20051430 | 1194 | 76 . . . 540 | 2833 |
| PROST20054260 | 1195 | 56 . . . 952 | 2834 |
| PROST20056040 | 1196 | 1235 . . . 1552 | 2835 |
| PROST20058800 | 1197 | 179 . . . 493 | 2836 |
| PROST20059190 | 1198 | 94 . . . 483 | 2837 |
| PROST20059430 | 1199 | 1475 . . . 1792 | 2838 |
| PROST20061960 | 1200 | 7 . . . 393 | 2839 |
| PROST20062600 | 1201 | 145 . . . 2367 | 2840 |
| PROST20064500 | 1202 | 146 . . . 466 | 2841 |
| PROST20067370 | 1203 | 1219 . . . 1944 | 2842 |
| PROST20069880 | 1204 | 45 . . . 2252 | 2843 |
| PROST20072370 | 1205 | 139 . . . 2256 | 2844 |
| PROST20072890 | 1206 | 1664 . . . 2632 | 2845 |
| PROST20073170 | 1207 | 166 . . . 1905 | 2846 |
| PROST20073890 | 1208 | 1022 . . . 1324 | 2847 |
| PROST20079740 | 1209 | 147 . . . 527 | 2848 |
| PROST20085160 | 1210 | 63 . . . 734 | 2849 |
| PROST20094830 | 1211 | 58 . . . 2328 | 2850 |
| PUAEN10000570 | 1212 | 127 . . . 2220 | 2851 |
| PUAEN10000810 | 1213 | 318 . . . 2234 | 2852 |
| PUAEN10001610 | 1214 | 582 . . . 3794 | 2853 |
| PUAEN10003220 | 1215 | 173 . . . 946 | 2854 |
| SALGL10000050 | 1216 | 298 . . . 933 | 2855 |
| SALGL10000470 | 1217 | 11 . . . 619 | 2856 |
| SALGL10000650 | 1218 | 193 . . . 543 | 2857 |
| SALGL10001570 | 1219 | 269 . . . 1282 | 2858 |
| SKMUS10000140 | 1220 | 68 . . . 1234 | 2859 |
| SKMUS10000220 | 1221 | 102 . . . 1367 | 2860 |
| SKMUS10000640 | 1222 | 137 . . . 1198 | 2861 |
| SKMUS10001040 | 1223 | 240 . . . 1100 | 2862 |
| SKMUS10001180 | 1224 | 300 . . . 1076 | 2863 |
| SKMUS10001240 | 1225 | 35 . . . >1069 | 2864 |
| SKMUS10001290 | 1226 | 66 . . . 749 | 2865 |
| SKMUS10001770 | 1227 | 203 . . . 1276 | 2866 |
| SKMUS20000740 | 1228 | 26 . . . 1135 | 2867 |
| SKMUS20001170 | 1229 | 105 . . . 1019 | 2868 |
| SKMUS20002710 | 1230 | 17 . . . 1174 | 2869 |
| SKMUS20003430 | 1231 | 163 . . . 861 | 2870 |
| SKMUS20003650 | 1232 | 32 . . . 388 | 2871 |
| SKMUS20003900 | 1233 | 135 . . . 1112 | 2872 |
| SKMUS20004580 | 1234 | 166 . . . >1905 | 2873 |
| SKMUS20004670 | 1235 | 141 . . . 443 | 2874 |
| SKMUS20004680 | 1236 | 4 . . . 453 | 2875 |
| SKMUS20007240 | 1237 | 107 . . . 1120 | 2876 |
| SKMUS20007740 | 1238 | 66 . . . 1061 | 2877 |
| SKMUS20008470 | 1239 | 183 . . . 524 | 2878 |
| SKMUS20008630 | 1240 | 294 . . . 1727 | 2879 |
| SKMUS20009020 | 1241 | 396 . . . 1631 | 2880 |
| SKMUS20009330 | 1242 | 96 . . . 752 | 2881 |

TABLE 1-continued

| Clone name | SEQ ID NO. of nucleotide sequence | Position of CDS | SEQ ID NO. of amino acid sequence |
|---|---|---|---|
| SKMUS20009450 | 1243 | 796 ... 1149 | 2882 |
| SKMUS20009540 | 1244 | 193 ... 1260 | 2883 |
| SKMUS20010080 | 1245 | 210 ... 839 | 2884 |
| SKMUS20011290 | 1246 | 116 ... 1375 | 2885 |
| SKMUS20011470 | 1247 | 255 ... 968 | 2886 |
| SKMUS20013640 | 1248 | 117 ... 476 | 2887 |
| SKMUS20014920 | 1249 | 199 ... 942 | 2888 |
| SKMUS20015010 | 1250 | 178 ... 921 | 2889 |
| SKMUS20015430 | 1251 | 53 ... 847 | 2890 |
| SKMUS20016080 | 1252 | 145 ... 1026 | 2891 |
| SKMUS20016310 | 1253 | 385 ... 876 | 2892 |
| SKMUS20016340 | 1254 | 274 ... >1622 | 2893 |
| SKMUS20016620 | 1255 | 30 ... 806 | 2894 |
| SKMUS20016680 | 1256 | 196 ... 1290 | 2895 |
| SKMUS20016710 | 1257 | 30 ... 722 | 2896 |
| SKNMC10000070 | 1258 | 1265 ... 1594 | 2897 |
| SKNMC10000100 | 1259 | 296 ... 694 | 2898 |
| SKNMC10000190 | 1260 | 1219 ... 1578 | 2899 |
| SKNMC10000290 | 1261 | 388 ... 789 | 2900 |
| SKNMC10001100 | 1262 | 405 ... 920 | 2901 |
| SKNMC10001590 | 1263 | 720 ... 1991 | 2902 |
| SKNMC10001680 | 1264 | 1187 ... 1927 | 2903 |
| SKNMC10002290 | 1265 | 1798 ... 2472 | 2904 |
| SKNMC10002510 | 1266 | 265 ... 2565 | 2905 |
| SKNMC10002640 | 1267 | 68 ... 718 | 2906 |
| SKNMC20000650 | 1268 | 55 ... 1758 | 2907 |
| SKNMC20000970 | 1269 | 340 ... 2028 | 2908 |
| SKNMC20002240 | 1270 | 797 ... 1939 | 2909 |
| SKNMC20003050 | 1271 | 154 ... >1168 | 2910 |
| SKNMC20003220 | 1272 | 351 ... 1091 | 2911 |
| SKNMC20003560 | 1273 | 69 ... 650 | 2912 |
| SKNMC20005930 | 1274 | 363 ... 1262 | 2913 |
| SKNMC20006120 | 1275 | 1176 ... 1589 | 2914 |
| SKNMC20010570 | 1276 | 79 ... 2085 | 2915 |
| SKNMC20011130 | 1277 | 98 ... 955 | 2916 |
| SKNMC20015030 | 1278 | 1129 ... 1689 | 2917 |
| SKNMC20015550 | 1279 | 463 ... 1035 | 2918 |
| SKNMC20015960 | 1280 | 74 ... >3352 | 2919 |
| SKNSH10000860 | 1281 | 786 ... 1250 | 2920 |
| SKNSH10001740 | 1282 | 361 ... 1458 | 2921 |
| SKNSH10003010 | 1283 | 464 ... 1669 | 2922 |
| SKNSH10003080 | 1284 | 389 ... 871 | 2923 |
| SKNSH20001510 | 1285 | 462 ... 776 | 2924 |
| SKNSH20001630 | 1286 | 1087 ... 1596 | 2925 |
| SKNSH20003470 | 1287 | 390 ... 863 | 2926 |
| SMINT10000160 | 1288 | 158 ... 1729 | 2927 |
| SMINT10000390 | 1289 | 740 ... 1045 | 2928 |
| SMINT10000420 | 1290 | 76 ... >2645 | 2929 |
| SMINT10000540 | 1291 | 97 ... 636 | 2930 |
| SMINT10000570 | 1292 | 70 ... 1545 | 2931 |
| SMINT10000710 | 1293 | 1763 ... >2065 | 2932 |
| SMINT10001000 | 1294 | 27 ... 470 | 2933 |
| SMINT10001030 | 1295 | 415 ... 2226 | 2934 |
| SMINT10001180 | 1296 | 1176 ... 1487 | 2935 |
| SMINT20000180 | 1297 | 1466 ... 1879 | 2936 |
| SMINT20000400 | 1298 | 243 ... 548 | 2937 |
| SMINT20001450 | 1299 | 11 ... 718 | 2938 |
| SMINT20002270 | 1300 | 1427 ... 1819 | 2939 |
| SMINT20002390 | 1301 | 517 ... 885 | 2940 |
| SMINT20002770 | 1302 | 220 ... 1167 | 2941 |
| SMINT20003960 | 1303 | 5 ... 2851 | 2942 |
| SMINT20004000 | 1304 | 408 ... 899 | 2943 |
| SMINT20005450 | 1305 | 1001 ... 1387 | 2944 |
| SMINT20005580 | 1306 | 1700 ... 2029 | 2945 |
| SPLEN10000490 | 1307 | 27 ... 1364 | 2946 |
| SPLEN10000910 | 1308 | 742 ... 1347 | 2947 |
| SPLEN10001430 | 1309 | 165 ... 695 | 2948 |
| SPLEN20000200 | 1310 | 1974 ... 2282 | 2949 |
| SPLEN20000470 | 1311 | 1030 ... 1560 | 2950 |
| SPLEN20000720 | 1312 | 808 ... 1842 | 2951 |
| SPLEN20001340 | 1313 | 61 ... 1146 | 2952 |
| SPLEN20001970 | 1314 | 414 ... 1310 | 2953 |
| SPLEN20002420 | 1315 | 661 ... 1191 | 2954 |
| SPLEN20002430 | 1316 | 344 ... 763 | 2955 |
| SPLEN20002670 | 1317 | 1638 ... >3316 | 2956 |
| SPLEN20002700 | 1318 | 69 ... 440 | 2957 |
| SPLEN20003100 | 1319 | 1001 ... 1321 | 2958 |
| SPLEN20003570 | 1320 | 928 ... 2322 | 2959 |
| SPLEN20004430 | 1321 | 509 ... 817 | 2960 |
| SPLEN20004960 | 1322 | 1792 ... 2175 | 2961 |
| SPLEN20005410 | 1323 | 12 ... 824 | 2962 |
| STOMA10000470 | 1324 | 135 ... 533 | 2963 |
| STOMA10000520 | 1325 | 1790 ... 2170 | 2964 |
| STOMA10001170 | 1326 | 196 ... 1818 | 2965 |
| STOMA10001330 | 1327 | 410 ... 1858 | 2966 |
| STOMA10001860 | 1328 | 364 ... 1476 | 2967 |
| STOMA20000320 | 1329 | 943 ... 1278 | 2968 |
| STOMA20000880 | 1330 | 1825 ... 2286 | 2969 |
| STOMA20001210 | 1331 | 196 ... 1458 | 2970 |
| STOMA20001880 | 1332 | 1068 ... 1757 | 2971 |
| STOMA20002570 | 1333 | 429 ... 746 | 2972 |
| STOMA20002890 | 1334 | 187 ... 801 | 2973 |
| STOMA20003960 | 1335 | 591 ... 1748 | 2974 |
| STOMA20004780 | 1336 | 129 ... 554 | 2975 |
| STOMA20004820 | 1337 | 206 ... 1228 | 2976 |
| SYNOV10001280 | 1338 | 111 ... 2084 | 2977 |
| SYNOV10001640 | 1339 | 206 ... 1033 | 2978 |
| SYNOV20001770 | 1340 | 359 ... 673 | 2979 |
| SYNOV20002910 | 1341 | 1085 ... 1750 | 2980 |
| SYNOV20008200 | 1342 | 461 ... >2203 | 2981 |
| SYNOV20010140 | 1343 | 72 ... 458 | 2982 |
| SYNOV20011440 | 1344 | 275 ... 1468 | 2983 |
| SYNOV20013740 | 1345 | 147 ... 1472 | 2984 |
| SYNOV20014510 | 1346 | 89 ... 982 | 2985 |
| SYNOV20014570 | 1347 | 1488 ... 1811 | 2986 |
| SYNOV20016480 | 1348 | 132 ... 656 | 2987 |
| TESTI10000230 | 1349 | 1101 ... 1415 | 2988 |
| TESTI10000250 | 1350 | 167 ... 2032 | 2989 |
| TESTI10000420 | 1351 | 175 ... 1863 | 2990 |
| TESTI10000510 | 1352 | 75 ... 2297 | 2991 |
| TESTI10000550 | 1353 | 46 ... 1185 | 2992 |
| TESTI10000640 | 1354 | 106 ... 1950 | 2993 |
| TESTI10000700 | 1355 | 225 ... 2042 | 2994 |
| TESTI10000960 | 1356 | 274 ... 978 | 2995 |
| TESTI10001250 | 1357 | 1027 ... 1641 | 2996 |
| TESTI10001270 | 1358 | 208 ... 1581 | 2997 |
| TESTI10001310 | 1359 | 38 ... 1549 | 2998 |
| TESTI10001380 | 1360 | 732 ... 1868 | 2999 |
| TESTI10001630 | 1361 | 249 ... 1298 | 3000 |
| TESTI10001680 | 1362 | 134 ... 1390 | 3001 |
| TESTI10001790 | 1363 | 1577 ... 1936 | 3002 |
| TESTI10001910 | 1364 | 935 ... 1786 | 3003 |
| TESTI20000180 | 1365 | 234 ... 563 | 3004 |
| TESTI20000440 | 1366 | 166 ... 2238 | 3005 |
| TESTI20001200 | 1367 | 664 ... 1059 | 3006 |
| TESTI20001540 | 1368 | 230 ... 1684 | 3007 |
| TESTI20001770 | 1369 | 1209 ... 2447 | 3008 |
| TESTI20001790 | 1370 | 154 ... 747 | 3009 |
| TESTI20001840 | 1371 | 16 ... 1962 | 3010 |
| TESTI20002070 | 1372 | 1161 ... 1631 | 3011 |
| TESTI20002080 | 1373 | 1784 ... 2425 | 3012 |
| TESTI20002380 | 1374 | 528 ... 1859 | 3013 |
| TESTI20002530 | 1375 | 289 ... 1071 | 3014 |
| TESTI20003560 | 1376 | 654 ... 1013 | 3015 |
| TESTI20003720 | 1377 | 578 ... 1144 | 3016 |
| TESTI20004350 | 1378 | 97 ... 726 | 3017 |
| TESTI20004620 | 1379 | 916 ... 1833 | 3018 |
| TESTI20005200 | 1380 | 192 ... 1379 | 3019 |
| TESTI20005910 | 1381 | 30 ... 1469 | 3020 |
| TESTI20006000 | 1382 | 645 ... 1682 | 3021 |
| TESTI20006270 | 1383 | 72 ... >2174 | 3022 |
| TESTI20006710 | 1384 | 334 ... 645 | 3023 |
| TESTI20006950 | 1385 | 68 ... >2012 | 3024 |
| TESTI20006990 | 1386 | 134 ... 2155 | 3025 |
| TESTI20007070 | 1387 | 56 ... 1084 | 3026 |
| TESTI20007620 | 1388 | 125 ... 961 | 3027 |
| TESTI20007840 | 1389 | 36 ... 3281 | 3028 |
| TESTI20008190 | 1390 | 820 ... 1236 | 3029 |
| TESTI20008300 | 1391 | 323 ... 1186 | 3030 |
| TESTI20008490 | 1392 | 59 ... 1333 | 3031 |

TABLE 1-continued

| Clone name | SEQ ID NO. of nucleotide sequence | Position of CDS | SEQ ID NO. of amino acid sequence |
|---|---|---|---|
| TESTI20008830 | 1393 | 1131 ... 1718 | 3032 |
| TESTI20009090 | 1394 | 562 ... 894 | 3033 |
| TESTI20009510 | 1395 | 225 ... 1115 | 3034 |
| TESTI20009700 | 1396 | 84 ... 1628 | 3035 |
| TESTI20010080 | 1397 | 1565 ... >2060 | 3036 |
| TESTI20010490 | 1398 | 730 ... 2349 | 3037 |
| TESTI20010820 | 1399 | 1609 ... 1926 | 3038 |
| TESTI20011340 | 1400 | 243 ... 1346 | 3039 |
| TESTI20011410 | 1401 | 425 ... 2725 | 3040 |
| TESTI20011800 | 1402 | 228 ... 1178 | 3041 |
| TESTI20012370 | 1403 | 257 ... 2071 | 3042 |
| TESTI20012690 | 1404 | 660 ... 2603 | 3043 |
| TESTI20013060 | 1405 | 125 ... 427 | 3044 |
| TESTI20013300 | 1406 | 22 ... >2563 | 3045 |
| TESTI20013450 | 1407 | 187 ... 1917 | 3046 |
| TESTI20013520 | 1408 | 334 ... 759 | 3047 |
| TESTI20014120 | 1409 | 185 ... 1384 | 3048 |
| TESTI20014200 | 1410 | 214 ... 1299 | 3049 |
| TESTI20015110 | 1411 | 61 ... 2058 | 3050 |
| TESTI20015120 | 1412 | 565 ... 1287 | 3051 |
| TESTI20015560 | 1413 | 400 ... 1326 | 3052 |
| TESTI20015930 | 1414 | 1157 ... 1468 | 3053 |
| TESTI20016210 | 1415 | 1121 ... 1474 | 3054 |
| TESTI20016610 | 1416 | 280 ... 3345 | 3055 |
| TESTI20016650 | 1417 | 2190 ... 2549 | 3056 |
| TESTI20016710 | 1418 | 1071 ... 2003 | 3057 |
| TESTI20017580 | 1419 | 143 ... 676 | 3058 |
| TESTI20017660 | 1420 | 317 ... 652 | 3059 |
| TESTI20017920 | 1421 | 84 ... 890 | 3060 |
| TESTI20018150 | 1422 | 815 ... 1993 | 3061 |
| TESTI20018260 | 1423 | 310 ... 1113 | 3062 |
| TESTI20018270 | 1424 | 19 ... 1899 | 3063 |
| TESTI20018290 | 1425 | 337 ... >2156 | 3064 |
| TESTI20018520 | 1426 | 46 ... 2211 | 3065 |
| TESTI20018620 | 1427 | 1355 ... 1729 | 3066 |
| TESTI20018690 | 1428 | 1178 ... 2425 | 3067 |
| TESTI20018790 | 1429 | 481 ... 1821 | 3068 |
| TESTI20018980 | 1430 | 146 ... 559 | 3069 |
| TESTI20019500 | 1431 | 126 ... 1403 | 3070 |
| TESTI20019680 | 1432 | 1168 ... 1509 | 3071 |
| TESTI20019910 | 1433 | 345 ... 1601 | 3072 |
| TESTI20020020 | 1434 | 1547 ... >1884 | 3073 |
| TESTI20020480 | 1435 | 255 ... 569 | 3074 |
| TESTI20020570 | 1436 | 217 ... 1317 | 3075 |
| TESTI20020810 | 1437 | 194 ... 1498 | 3076 |
| TESTI20020900 | 1438 | 81 ... 1547 | 3077 |
| TESTI20021050 | 1439 | 68 ... 2689 | 3078 |
| TESTI20021490 | 1440 | 45 ... 1814 | 3079 |
| TESTI20022230 | 1441 | 205 ... 783 | 3080 |
| TESTI20022450 | 1442 | 59 ... 1333 | 3081 |
| TESTI20022510 | 1443 | 97 ... 2217 | 3082 |
| TESTI20022560 | 1444 | 17 ... 2494 | 3083 |
| TESTI20022640 | 1445 | 260 ... 913 | 3084 |
| TESTI20022940 | 1446 | 41 ... 469 | 3085 |
| TESTI20023610 | 1447 | 365 ... 949 | 3086 |
| TESTI20023690 | 1448 | 336 ... 1160 | 3087 |
| TESTI20024150 | 1449 | 400 ... 1080 | 3088 |
| TESTI20024230 | 1450 | 125 ... 1339 | 3089 |
| TESTI20024610 | 1451 | 181 ... 1605 | 3090 |
| TESTI20024650 | 1452 | 45 ... 1829 | 3091 |
| TESTI20024670 | 1453 | 1375 ... 1845 | 3092 |
| TESTI20024980 | 1454 | 261 ... 1889 | 3093 |
| TESTI20025160 | 1455 | 133 ... 1164 | 3094 |
| TESTI20025440 | 1456 | 293 ... 1819 | 3095 |
| TESTI20025800 | 1457 | 60 ... 1022 | 3096 |
| TESTI20026320 | 1458 | 31 ... 414 | 3097 |
| TESTI20026760 | 1459 | 830 ... 1663 | 3098 |
| TESTI20026980 | 1460 | 212 ... 1354 | 3099 |
| TESTI20027000 | 1461 | 22 ... 573 | 3100 |
| TESTI20027070 | 1462 | 88 ... 1410 | 3101 |
| TESTI20027290 | 1463 | 158 ... 1333 | 3102 |
| TESTI20027890 | 1464 | 104 ... >1506 | 3103 |
| TESTI20028060 | 1465 | 1596 ... 1970 | 3104 |
| TESTI20028400 | 1466 | 740 ... 1066 | 3105 |
| TESTI20028660 | 1467 | 1111 ... 1995 | 3106 |
| TESTI20029120 | 1468 | 295 ... 1920 | 3107 |
| TESTI20029650 | 1469 | 391 ... 1446 | 3108 |
| TESTI20030050 | 1470 | 21 ... 800 | 3109 |
| TESTI20030370 | 1471 | 271 ... 1368 | 3110 |
| TESTI20030590 | 1472 | 1028 ... 1474 | 3111 |
| TESTI20030710 | 1473 | 88 ... 666 | 3112 |
| TESTI20030740 | 1474 | 85 ... 2055 | 3113 |
| TESTI20031090 | 1475 | 28 ... >2034 | 3114 |
| TESTI20031170 | 1476 | 188 ... 1660 | 3115 |
| TESTI20031300 | 1477 | 157 ... 2004 | 3116 |
| TESTI20031520 | 1478 | 150 ... 1862 | 3117 |
| TESTI20031930 | 1479 | 474 ... 1010 | 3118 |
| TESTI20031960 | 1480 | 32 ... >1839 | 3119 |
| TESTI20032280 | 1481 | 189 ... 560 | 3120 |
| TESTI20032550 | 1482 | 242 ... 670 | 3121 |
| TESTI20032800 | 1483 | 1445 ... 1873 | 3122 |
| TESTI20032990 | 1484 | 49 ... 411 | 3123 |
| TESTI20033250 | 1485 | 98 ... 2041 | 3124 |
| TESTI20033270 | 1486 | 48 ... 722 | 3125 |
| TESTI20033540 | 1487 | 311 ... 1930 | 3126 |
| TESTI20033560 | 1488 | 193 ... 1296 | 3127 |
| TESTI20033760 | 1489 | 294 ... 659 | 3128 |
| TESTI20034130 | 1490 | 109 ... >2444 | 3129 |
| TESTI20034180 | 1491 | 1113 ... 1484 | 3130 |
| TESTI20034190 | 1492 | 120 ... 1520 | 3131 |
| TESTI20034980 | 1493 | 265 ... 1185 | 3132 |
| TESTI20035120 | 1494 | 321 ... 2585 | 3133 |
| TESTI20035410 | 1495 | 735 ... 1208 | 3134 |
| TESTI20035510 | 1496 | 734 ... 1741 | 3135 |
| TESTI20035740 | 1497 | 41 ... 1651 | 3136 |
| TESTI20035800 | 1498 | 1263 ... 1583 | 3137 |
| TESTI20035890 | 1499 | 206 ... 1507 | 3138 |
| TESTI20036250 | 1500 | 45 ... 2216 | 3139 |
| TESTI20036490 | 1501 | 88 ... 459 | 3140 |
| TESTI20037270 | 1502 | 33 ... 1391 | 3141 |
| TESTI20037810 | 1503 | 128 ... 520 | 3142 |
| TESTI20038940 | 1504 | 1166 ... 1630 | 3143 |
| TESTI20039140 | 1505 | 73 ... 1530 | 3144 |
| TESTI20039980 | 1506 | 2 ... 514 | 3145 |
| TESTI20040000 | 1507 | 291 ... 881 | 3146 |
| TESTI20040310 | 1508 | 126 ... 1463 | 3147 |
| TESTI20041110 | 1509 | 143 ... 502 | 3148 |
| TESTI20041220 | 1510 | 33 ... 1703 | 3149 |
| TESTI20042070 | 1511 | 95 ... 1903 | 3150 |
| TESTI20042290 | 1512 | 647 ... 1711 | 3151 |
| TESTI20042430 | 1513 | 1227 ... 1535 | 3152 |
| TESTI20042870 | 1514 | 1697 ... 2263 | 3153 |
| TESTI20042950 | 1515 | 187 ... 1887 | 3154 |
| TESTI20047120 | 1516 | 112 ... 1002 | 3155 |
| TESTI20049290 | 1517 | 402 ... 1226 | 3156 |
| TESTI20049820 | 1518 | 157 ... 1875 | 3157 |
| TESTI20049940 | 1519 | 50 ... 550 | 3158 |
| TESTI20051550 | 1520 | 79 ... 501 | 3159 |
| TESTI20052680 | 1521 | 60 ... 1247 | 3160 |
| TESTI20053960 | 1522 | 402 ... 2522 | 3161 |
| TESTI20054080 | 1523 | 108 ... 929 | 3162 |
| TESTI20054920 | 1524 | 137 ... 568 | 3163 |
| TESTI20055840 | 1525 | 210 ... 1214 | 3164 |
| TESTI20056900 | 1526 | 124 ... 1788 | 3165 |
| TESTI20057310 | 1527 | 287 ... >1853 | 3166 |
| TESTI20057420 | 1528 | 164 ... 1636 | 3167 |
| TESTI20058600 | 1529 | 430 ... 1167 | 3168 |
| TESTI20062380 | 1530 | 719 ... 1567 | 3169 |
| TESTI20062550 | 1531 | 511 ... 837 | 3170 |
| TESTI20064250 | 1532 | 537 ... 1436 | 3171 |
| TESTI20064830 | 1533 | 373 ... 1614 | 3172 |
| TESTI20065720 | 1534 | 222 ... 644 | 3173 |
| TESTI20067740 | 1535 | 382 ... 1239 | 3174 |
| TESTI20068660 | 1536 | 87 ... 1337 | 3175 |
| TESTI20068720 | 1537 | 378 ... 1331 | 3176 |
| TESTI20069780 | 1538 | 310 ... 639 | 3177 |
| TESTI20069790 | 1539 | 887 ... 1189 | 3178 |
| TESTI20071830 | 1540 | 352 ... 1176 | 3179 |
| TESTI20073580 | 1541 | 3 ... 1394 | 3180 |
| TESTI20074020 | 1542 | 1097 ... 1426 | 3181 |

TABLE 1-continued

| Clone name | SEQ ID NO. of nucleotide sequence | Position of CDS | SEQ ID NO. of amino acid sequence |
|---|---|---|---|
| TESTI20074640 | 1543 | 204 . . . >1824 | 3182 |
| TESTI20074660 | 1544 | 124 . . . 1683 | 3183 |
| TESTI20074800 | 1545 | 81 . . . 2000 | 3184 |
| TESTI20076130 | 1546 | 122 . . . >2107 | 3185 |
| TESTI20077490 | 1547 | 852 . . . 1598 | 3186 |
| TESTI20077500 | 1548 | 391 . . . 1722 | 3187 |
| TESTI20078140 | 1549 | 897 . . . 1400 | 3188 |
| TESTI20078640 | 1550 | 287 . . . 802 | 3189 |
| TESTI20078670 | 1551 | 318 . . . 1952 | 3190 |
| TESTI20078720 | 1552 | 92 . . . 1309 | 3191 |
| TESTI20079510 | 1553 | 824 . . . 3025 | 3192 |
| TESTI20080200 | 1554 | 153 . . . 2429 | 3193 |
| TESTI20080330 | 1555 | 72 . . . 497 | 3194 |
| TESTI20081390 | 1556 | 118 . . . 1839 | 3195 |
| TESTI20081440 | 1557 | 147 . . . 545 | 3196 |
| TESTI20082340 | 1558 | 931 . . . 1419 | 3197 |
| TESTI20082400 | 1559 | 409 . . . 834 | 3198 |
| TESTI20083430 | 1560 | 157 . . . 2979 | 3199 |
| TESTI20083870 | 1561 | 31 . . . 552 | 3200 |
| TESTI20084400 | 1562 | 1749 . . . 2078 | 3201 |
| TESTI20086570 | 1563 | 246 . . . 1289 | 3202 |
| TESTI20087740 | 1564 | 14 . . . 1900 | 3203 |
| TESTI20088470 | 1565 | 362 . . . 757 | 3204 |
| TESTI20136910 | 1566 | 1667 . . . 2026 | 3205 |
| TESTI20138320 | 1567 | 98 . . . 1060 | 3206 |
| TESTI20140360 | 1568 | 831 . . . 1349 | 3207 |
| TESTI20177400 | 1569 | 70 . . . 1584 | 3208 |
| TESTI30000020 | 1570 | 97 . . . 1914 | 3209 |
| THYMU10000020 | 1571 | 286 . . . 1131 | 3210 |
| THYMU10000320 | 1572 | 1299 . . . 1691 | 3211 |
| THYMU10000830 | 1573 | 1169 . . . 1936 | 3212 |
| THYMU10001050 | 1574 | 632 . . . 934 | 3213 |
| THYMU10001760 | 1575 | 1 . . . 492 | 3214 |
| THYMU10002910 | 1576 | 1598 . . . 2026 | 3215 |
| THYMU10003290 | 1577 | 22 . . . 534 | 3216 |
| THYMU10003590 | 1578 | 743 . . . 2005 | 3217 |
| THYMU10003660 | 1579 | 1749 . . . 2084 | 3218 |
| THYMU10003820 | 1580 | 1242 . . . 1601 | 3219 |
| THYMU10004590 | 1581 | 594 . . . 1142 | 3220 |
| THYMU10004730 | 1582 | 421 . . . 735 | 3221 |
| THYMU10004910 | 1583 | 301 . . . 1119 | 3222 |
| THYMU10005270 | 1584 | 1706 . . . >2057 | 3223 |
| THYMU10005580 | 1585 | 896 . . . 1819 | 3224 |
| THYMU20001400 | 1586 | 42 . . . 410 | 3225 |
| THYMU20002360 | 1587 | 2 . . . 385 | 3226 |
| THYMU20003170 | 1588 | 703 . . . 1041 | 3227 |
| THYMU20003690 | 1589 | 328 . . . 1782 | 3228 |
| TRACH10000180 | 1590 | 63 . . . 1205 | 3229 |
| TRACH10000300 | 1591 | 384 . . . 902 | 3230 |
| TRACH10000570 | 1592 | 722 . . . 1039 | 3231 |
| TRACH10000630 | 1593 | 431 . . . 1372 | 3232 |
| TRACH10000740 | 1594 | 80 . . . 1672 | 3233 |
| TRACH10001000 | 1595 | 181 . . . 660 | 3234 |
| TRACH10001060 | 1596 | 744 . . . 1121 | 3235 |
| TRACH10001250 | 1597 | 21 . . . 1610 | 3236 |
| TRACH10001400 | 1598 | 266 . . . 622 | 3237 |
| TRACH20000150 | 1599 | 1303 . . . 1755 | 3238 |
| TRACH20000790 | 1600 | 47 . . . 385 | 3239 |
| TRACH20001850 | 1601 | 19 . . . 750 | 3240 |
| TRACH20001960 | 1602 | 144 . . . 974 | 3241 |
| TRACH20002350 | 1603 | 1123 . . . 1437 | 3242 |
| TRACH20002370 | 1604 | 197 . . . 1471 | 3243 |
| TRACH20002500 | 1605 | 120 . . . 1682 | 3244 |
| TRACH20002890 | 1606 | 895 . . . 2022 | 3245 |
| TRACH20003930 | 1607 | 1403 . . . >2562 | 3246 |
| TRACH20004110 | 1608 | 150 . . . 1844 | 3247 |
| TRACH20004200 | 1609 | 80 . . . >2895 | 3248 |
| TRACH20004610 | 1610 | 498 . . . 2084 | 3249 |
| TRACH20004720 | 1611 | 435 . . . 1940 | 3250 |
| TRACH20004960 | 1612 | 115 . . . 1842 | 3251 |
| TRACH20004970 | 1613 | 1083 . . . 1517 | 3252 |
| TRACH20006650 | 1614 | 208 . . . 1866 | 3253 |
| TRACH20006750 | 1615 | 232 . . . 1200 | 3254 |
| TRACH20007670 | 1616 | 1147 . . . 1452 | 3255 |
| TRACH20007800 | 1617 | 492 . . . 1937 | 3256 |
| TRACH20008940 | 1618 | 701 . . . 1957 | 3257 |
| TRACH20008980 | 1619 | 350 . . . 661 | 3258 |
| TRACH20009260 | 1620 | 75 . . . 770 | 3259 |
| TRACH20009440 | 1621 | 879 . . . 1235 | 3260 |
| TRACH20011920 | 1622 | 530 . . . >2034 | 3261 |
| TRACH20012890 | 1623 | 143 . . . 715 | 3262 |
| TRACH20013950 | 1624 | 1697 . . . 2602 | 3263 |
| TRACH20014000 | 1625 | 1626 . . . 1949 | 3264 |
| TRACH20015920 | 1626 | 569 . . . 877 | 3265 |
| TRACH20016070 | 1627 | 484 . . . 1176 | 3266 |
| UMVEN10001220 | 1628 | 698 . . . 1339 | 3267 |
| UMVEN20001330 | 1629 | 164 . . . 2242 | 3268 |
| UTERU10000770 | 1630 | 2074 . . . 2418 | 3269 |
| UTERU10000960 | 1631 | 952 . . . 1593 | 3270 |
| UTERU10001600 | 1632 | 527 . . . 1747 | 3271 |
| UTERU10001920 | 1633 | 112 . . . 474 | 3272 |
| UTERU20000470 | 1634 | 1691 . . . >2197 | 3273 |
| UTERU20003380 | 1635 | 130 . . . 816 | 3274 |
| UTERU20003930 | 1636 | 514 . . . 1101 | 3275 |
| UTERU20004850 | 1637 | 385 . . . 732 | 3276 |
| UTERU20005410 | 1638 | 432 . . . 800 | 3277 |
| UTERU20005690 | 1639 | 217 . . . 1899 | 3278 |

Namely, primers used to synthesize polynucleotides can be designed based on the nucleotide sequences of polynucleotides of the present invention shown in SEQ ID NOs in the above Table 1. When one intends to synthesize full-length cDNAs, an oligo. dT primer can be used as the 3'-end primer. The length of the primers is usually 15–100 bp, and favorably between 15–35 bp. In case of LA PCR, which is described below, the primer length of 25–35 bp may provide a good result.

A method to design a primer that enables a specific amplification based on the aimed nucleotide sequence is known to those skilled in the art (Current Protocols in Molecular Biology, Ausubel et al. edit, (1987) John Wiley & Sons, Section 6.1–6.4). In designing a primer based on the 5'-end sequence, the primer is designed so as that, in principle, the amplification products will include the translation start site. Accordingly, for example, when the 5'-end primer is designed based on the nucleotide sequence of 5' untranslated region (5'UTR), any part of the 5'-end, which ensures the specificity to the cDNA of interest, can be selected as the primer.

When synthesizing a full-length cDNA, the target nucleotide sequence to be amplified can extend to several thousand bp in some cDNA. However, it is possible to amplify such a long nucleotides by using such as LA PCR (Long and Accurate PCR). It is advantageous to use LA PCR when synthesizing long DNA. In LA PCR, in which a special DNA polymerase having 3'->5' exonuclease activity is used, misincorporated nucleotides can be removed. Accordingly, accurate synthesis of the complementary strand can be achieved even with a long nucleotide sequence. By using LA PCR, it is reported that amplification of a nucleotide with 20 kb longer can be achieved under desirable conditions (Takeshi Hayashi (1996) Jikken-Igaku Bessatsu, "Advanced Technologies in PCR" Youdo-sha).

A template DNA for synthesizing the full-length cDNA of the present invention can be obtained by using cDNA libraries that are prepared by various methods. The full-length cDNA clones of the present invention are clones with high probability of completeness in length, which were obtained by the method comprising the steps of [1] preparing libraries containing cDNAs with the very high fullness ratio by oligo-capping, and [2] assembling the 5'-end sequences and selecting one with the highest probability of completeness in length in the cluster formed (there are many clones longer in the 5'-end direction).

However, the uses of primers designed based on the full-length nucleotide sequences provided by the present invention enable easily obtaining full-length cDNAs without such a special technique.

The problem with the cDNA libraries prepared by the known methods or commercially available is that mRNA contained in the libraries has very low fullness ratio. Thus, it is difficult to screen full-length cDNA clone directly from the library using ordinary cloning methods. The present invention has revealed a nucleotide sequence of novel full-length cDNA. If a full-length nucleotide sequence is provided, it is possible to synthesize a target full-length cDNA by using enzymatic reactions such as PCR. In particular, a full-length-enriched cDNA library, synthesized by methods such as oligo-capping, is desirable to synthesize a full-length cDNA with more reliability.

The 5'-end sequence of the full-length cDNA clones of the invention can be used to isolate the regulatory element of transcription including the promoter on the genome. A rough draft of the human genome (analysis of human genomic sequence with lower accuracy), which covers 90% of the genome, has been reported (Nature, Vol. 409, 814–823, 2001), and by the year 2003, analysis of the entire human genomic sequence is going to be finished. However, it is hard to analyze with software the transcription start sites on the human genome, in which long introns exist. By contrast, it is easy to specify the transcription start site on the genomic sequence using the nucleotide sequence which includes the 5'-end of the full-length cDNA clone of the present invention, and thus it is easy to obtain the genomic region involved in transcription regulation, which includes the promoter that is contained in the upstream of the transcription start site.

The polypeptide encoded by the full-length cDNA of the invention can be prepared as a recombinant polypeptide or as a natural polypeptide. For example, the recombinant polypeptide can be prepared by inserting the polynucleotide encoding the polypeptide of the invention into a vector, introducing the vector into an appropriate host cell and purifying the polypeptide expressed within the transformed host cell, as described below. In contrast, the natural polypeptide can be prepared, for example, by utilizing an affinity column to which an antibody against the polypeptide of the invention (Current Protocols in Molecular Biology (1987) Ausubel et al. edit, John Wiley & Sons, Section 16.1–16.19) is attached. The antibody used for affinity purification may be either a polyclonal antibody, or a monoclonal antibody. Alternatively, in vitro translation (See, for example, "On the fidelity of mRNA translation in the nuclease-treated rabbit reticulocyte lysate system." Dasso M. C., and Jackson R. J. (1989) Nucleic Acids Res. 17: 3129–3144) may be used for preparing the polypeptide of the invention.

Polypeptides functionally equivalent to the polypeptides of the present invention can be prepared based on the activities, which were clarified in the above-mentioned manner, of the polypeptides of the present invention. Using the biological activity possessed by the polypeptide of the invention as an index, it is possible to verify whether or not a particular polypeptide is functionally equivalent to the polypeptide of the invention by examining whether or not the polypeptide has said activity.

Polypeptides functionally equivalent to the polypeptides of the present invention can be prepared by those skilled in the art, for example, by using a method for introducing mutations into an amino acid sequence of a polypeptide (for example, site-directed mutagenesis (Current Protocols in Molecular Biology, edit, Ausubel et al., (1987) John Wiley & Sons, Section 8.1–8.5) Besides, such polypeptides can be generated by spontaneous mutations. The present invention also includes a polypeptide comprising the amino acid sequence shown in Table 1 in which one or more amino acids are substituted, deleted, inserted, and/or added, as long as the polypeptides have the equivalent functions to those of the polypeptides identified in the present Examples described later.

There are no limitations on the number and sites of amino acid mutations, as long as the polypeptides maintain the functions thereof. The number of mutations typically corresponds to 30% or less, or 20% or less, or 10% or less, preferably 5% or less, or 3% or less of the total amino acids, more preferably 2% or less or 1% or less of the total amino acids. Alternatively, herein, substitution of one or more amino acids includes substitution of several amino acids. As used herein, the term "several amino acids" means, for example, 5 amino acids, preferably 4 or 3 amino acids, more preferably 2 amino acids, and further preferably 1 amino acid.

From the viewpoint of maintaining the polypeptide function, it is preferable that a substituted amino acid has a similar property to that of the original amino acid. For example, Ala, Val, Leu, Ile, Pro, Met, Phe and Trp are assumed to have similar properties to one another because they are all classified into a group of non-polar amino acids. Similarly, substitution can be performed among non-charged amino acid such as Gly, Ser, Thr, Cys, Tyr, Asn, and Gln, acidic amino acids such as Asp and Glu, and basic amino acids such as Lys, Arg, and His.

In addition, polypeptides functionally equivalent to the polypeptides of the present invention can be isolated by using techniques of hybridization or gene amplification known to those skilled in the art. Specifically, using the hybridization technique (Current Protocols in Molecular Biology, edit, Ausubel et al., (1987) John Wiley & Sons, Section 6.3–6.4)), those skilled in the art can usually isolate a polynucleotide highly homologous to the polynucleotide encoding the polypeptide identified in the present Example based on the identified nucleotide sequence (Table 1) or a portion thereof and obtain the functionally equivalent polypeptide from the isolated polynucleotide. The present invention include polypeptides encoded by the polynucleotides hybridizing with the polynucleotides encoding the polypeptides identified in the present Example, as long as the polypeptides are functionally equivalent to the polypeptides identified in the present Example. Organisms from which the functionally equivalent polypeptides are isolated are illustrated by vertebrates such as human, mouse, rat, rabbit, pig and bovine, but are not limited to these animals.

Washing conditions of hybridization for the isolation of polynucleotides encoding the functionally equivalent polypeptides are usually "1×SSC, 0.1% SDS, 37° C."; more stringent conditions are "0.5×SSC, 0.1% SDS, 42° C."; and still more stringent conditions are "0.1×SSC, 0.1% SDS, 65° C.". Alternatively, the following conditions can be given as hybridization conditions of the present invention. Namely, conditions in which the hybridization is done at "6×SSC, 40% Formamide, 25° C.", and the washing at "1×SSC, 55° C." can be given. More preferable conditions are those in which the hybridization is done at "6×SSC, 40%

Formamide, 37° C.", and the washing at "0.2×SSC, 55° C.". Even more preferable are those in which the hybridization is done at "6×SSC, 50% Formamide, 37° C.", and the washing at "0.1×SSC, 62° C.". The more stringent the conditions of hybridization are, the more frequently the polynucleotides highly homologous to the probe sequence are isolated. Therefore, it is preferable to conduct hybridization under stringent conditions. Examples of stringent conditions in the present invention are, washing conditions of "0.5×SSC, 0.1% SDS, 42° C.", or alternatively, hybridization conditions of "6×SSC, 40% Formamide, 37° C.", and the washing at "0.2×SSC, 55° C.".

One skilled in the art can suitably select various conditions, such as dilution ratios of SSC, formamide concentrations, and temperatures to accomplish a similar stringency.

However, the above-mentioned combinations of SSC, SDS and temperature conditions are indicated just as examples. Those skilled in the art can select the hybridization conditions with similar stringency to those mentioned above by properly combining the above-mentioned or other factors (for example, probe concentration, probe length and duration of hybridization reaction) that determines the stringency of hybridization.

The amino acid sequences of polypeptides isolated by using the hybridization techniques usually have high identity to those of the polypeptides of the present invention, which are shown in Table 1. The present invention encompasses a polynucleotide comprising a nucleotide sequence that has a high identity to the nucleotide sequence of claim 1(a). Furthermore, the present invention encompasses a peptide, or polypeptide comprising an amino acid sequence that has a high identity to the amino acid sequence encoded by the polynucleotide of claim 1(b). The term "high identity" indicates sequence identity of at least 40% or more; preferably 60% or more; and more preferably 70% or more. Alternatively, more preferable is identity of 90% or more, or 93% or more, or 95% or more, furthermore, 97% or more, or 99% or more. The identity can be determined by using the BLAST search algorithm.

As used herein, "percent identity" of amino acid sequences or nucleic acids is determined using the algorithm BLAST of Karlin and Altschul (Proc. Natl. Acad. Sci. USA 90:5873–5877, 1993). Such an algorithm is incorporated into the BLASTN and BLASTX programs of Altschul et al. (J. Mol. Biol. 215:403–410, 1990). BLAST nucleotide searches are performed with the BLASTN program, for example, score=100, wordlength=12. BLAST protein searches are performed with the BLASTX program, for example, score=50, wordlength=3. When utilizing BLAST and Gapped BLAST programs, the default parameters of the respective programs are used.

With the gene amplification technique (PCR) (Current Protocols in Molecular Biology, edit, Ausubel et al., (1987) John Wiley & Sons, Section 6.1–6.4)) using primers designed based on the nucleotide sequence (Table 1) or a portion thereof identified in the present Example, it is possible to isolate a polynucleotide fragment highly homologous to the polynucleotide sequence or a portion thereof and to obtain functionally equivalent polypeptide to a particular polypeptide identified in the present Example based on the isolated polynucleotide fragment.

The present invention also provides a polynucleotide containing at least 15 nucleotides complementary to a polynucleotide comprising a nucleotide sequence of SEQ ID NOs shown in Table 1 or the complementary strand thereof. Herein, the term "complementary strand" is defined as one strand of a double strand DNA composed of A:T and G:C base pair to the other strand. Also, "complementary" is defined as not only those completely matching within a continuous region of at least 15 nucleotides, but also having a identity of at least 70%, favorably 80% or higher, more favorably 90% or higher, and most favorably 95% or higher within that region. The identity may be determined using the algorithm described herein.

Such a polynucleotide includes probes and primers used for the detection and amplification of a polynucleotide encoding the inventive polypeptide. When used as a primer, the polynucleotide usually comprises 15 to 100 bp, and preferably of 15 to 35 bp. When used as a probe, the polynucleotide comprises the whole or a part of the sequence of a polynucleotide of the invention, and comprises at least 15 bp. When used as primers, such polynucleotides are complementary at the 3'-end, and restriction enzyme recognition sequences or tags can be added to the 5'-end.

Furthermore, polynucleotides of the present invention include an antisense polynucleotide for suppressing the expression of a polypeptide of the invention, which comprises an amino acid sequence of SEQ ID NOs shown in Table 1. To exert an antisense effect, an antisense polynucleotide has at least 15 bp or more, for example 50 bp or more, preferably 100 bp or more, and more preferably 500 bp or more, and usually has 3000 bp or less, and preferably 2000 bp or less. Antisense polynucleotides can be used in the gene therapy of diseases caused by abnormalities of the polypeptides of the invention (abnormal function or abnormal expression). An antisense polynucleotide can be prepared, for example, by the phosphorothioate method ("Physicochemical properties of phosphorothioate oligodeoxynucleotides." Stein (1988) Nucleic Acids Res. 16: 3209–3221) based on the sequence information of polynucleotide encoding a polypeptide of the invention (for example, the nucleotide sequences of SEQ ID NO: 1 to 1639).

The polynucleotides or antisense polynucleotides of the present invention can be used in, for example, gene therapy. As target diseases, for example, cancers or various inflammatory diseases may be preferable. These molecules can be used for gene therapy, for example, by administrating them to patients by the in vivo or ex vivo method using virus vectors such as retrovirus vectors, adenovirus vectors, and adeno-related virus vectors, or non-virus vectors such as liposomes.

The present invention also includes a partial peptide of the polypeptides of the invention. The partial peptide comprises a polypeptide generated as a result that a signal peptide has been removed from a secretory protein. If the polypeptide of the present invention has an activity as a receptor or a ligand, the partial peptide may function as a competitive inhibitor of the polypeptide and may bind to the receptor (or ligand). In addition, the present invention includes an antigen peptide for raising antibodies. For the peptides to be specific for the polypeptide of the invention, the peptides comprise at least 7 amino acids, preferably 8 amino acids or more, more preferably 9 amino acids or more, and even more preferably 10 amino acids or more. The peptide can be used for preparing antibodies against the polypeptide of the invention, or competitive inhibitors of them, and also screening for a receptor that binds to the polypeptide of the invention. The partial peptides of the invention can be produced, for example, by genetic engineering methods, known methods for synthesizing peptides, or digesting the polypeptide of the invention with an appropriate peptidase.

The present invention also relates to a vector into which a polynucleotide of the invention is inserted. The vector of the invention is not limited as long as it contains the inserted polynucleotide stably. For example, if E. coli is used as a host, vectors such as pBluescript vector (Stratagene) are preferable as a cloning vector. To produce the polypeptide of the invention, expression vectors are especially useful. Any expression vector can be used as long as it is capable of expressing the polypeptide in vitro, in E. coli, in cultured cells, or in vivo. For example, pBEST vector (Promega) is preferable for in vitro expression, pET vector (Invitrogen) for E. coli, pME18S-FL3 vector (GenBank Accession No. AB009864) for cultured cells, and pME18S vector (Mol. Cell. Biol. (1988) 8: 466–472) for in vivo expression. To insert the polynucleotide of the invention, ligation utilizing restriction sites can be performed according to the standard method (Current Protocols in Molecular Biology (1987) Ausubel et al. edit, John Wiley & Sons, Section 11.4–11.11).

Recently, the technique of GATEWAY™ system (Invitrogen), which is an expression vector construction system for polypeptide expression, has been developed (Experimental Medicine, Vol. 18, No. 19 (December), p2716–2717, 2000). This system includes two types of site-specific recombinases (BP CLONASE™ and LR CLONASE™) derived from lambda phage and uses BP CLONASE™-specific recombination sites for an Entry Vector and LR CLONASE™-specific recombination sites for a Destination Vector, which may comprise a tag useful for polypeptide purification. With this system, an expression vector can be obtained by using homologous recombination.

First, a polynucleotide fragment of interest is inserted into the entry vector using the first recombination. Then, the secondary recombination is allowed to take place between the entry vector, where the polynucleotide fragment of interest has been inserted, and the destination vector. Thus, the expression vector can be prepared rapidly and highly efficiently. With the above-mentioned typical method using restriction enzyme and ligase reactions, the step of expression vector construction and expression of polypeptide of interest takes about 7 to 10 days. However, with the GATEWAY.™. system, the polypeptide of interest can be expressed and prepared in only 3 to 4 days. Thus, the system ensures a high-throughput functional analysis for expressed polypeptides.

The present invention also relates to a transformant carrying the vector of the invention. Any cell can be used as a host into which the vector of the invention is inserted, and various kinds of host cells can be used depending on the purposes. For strong expression of the polypeptide in eukaryotic cells, COS cells or CHO cells can be used, for example.

Introduction of the vector into host cells can be performed, for example, by calcium phosphate precipitation method, electroporation method (Current Protocols in Molecular Biology (1987) Ausubel et al. edit, John Wiley & Sons, Section 9.1–9.9) lipofectamine method (GIBCO-BRL), or microinjection method, etc.

Further, a polynucleotide containing at least 15 nucleotides comprising a nucleotide sequence of any one of the polynucleotides comprising the nucleotide sequences of SEQ ID NOs shown in Table 1 or the complementary strand thereof can be used not only as a primer for synthesizing full-length cDNAs but also for testing and diagnosing the abnormalities of the polypeptide encoded by the full-length cDNA of the present invention. For example, by utilizing polymerase chain reaction (genomic DNA-PCR, or RT-PCR) using the polynucleotide of the invention as a primer, polynucleotide encoding the polypeptide of the invention can be amplified. It is also possible to obtain the regulatory region of expression in the 5'-upstream by using PCR or hybridization since the transcription start site within the genomic sequence can be easily specified based on the 5'-end sequence of the full-length cDNA. The obtained genomic region can be used for detection and/or diagnosis of the abnormality of the sequence by RFLP analysis, SSCP, or sequencing. Especially, in the case where expression of the mRNA of the present invention varies according to a specific disease, analysis of the amount of expression of the mRNA using the polynucleotide of the present invention as a probe or a primer enables detection and diagnosis of the disease.

The present invention also relates to antibodies that bind to the polypeptide of the invention. There are no limitations in the form of the antibodies of the invention. They include polyclonal antibodies, monoclonal antibodies, or their portions that can bind to an antigen. They also include antibodies of all classes. Furthermore, special antibodies such as humanized antibodies and chimeric antibodies are also included.

The polyclonal antibody of the invention can be obtained according to the standard method by synthesizing an oligopeptide corresponding to the amino acid sequence and immunizing rabbits with the peptide (Current Protocols in Molecular Biology (1987) Ausubel et al. edit, John Wiley & Sons, Section 11.12–11.13) The monoclonal antibody of the invention can be obtained according to the standard method by purifying the polypeptide expressed in E. coli, immunizing mice with the polypeptide, and producing a hybridoma cell by fusing the spleen cells and myeloma cells (Current Protocols in Molecular Biology (1987) Ausubel et al. edit, John Wiley & Sons, Section 11.4–11.11).

The antibody binding to the polypeptide of the present invention can be used for purification of the polypeptide of the invention, and also for detection and/or diagnosis of the abnormalities of the expression and structure of the polypeptide. Specifically, polypeptides can be extracted, for example, from tissues, blood, or cells, and the polypeptide of the invention is detected by Western blotting, immunoprecipitation, or ELISA, etc. for the above purpose.

Furthermore, the antibody binding to the polypeptide of the present invention can be utilized for treating the diseases that associates with the polypeptide of the invention. If the antibodies are used for treating patients, human antibodies, humanized antibodies, or chimeric antibodies are preferable in terms of their low antigenicity. The human antibodies can be prepared by immunizing a mouse whose immune system is replaced with that of human (e.g., see "Functional transplant of megabase human immunoglobulin loci recapitulates human antibody response in mice" Mendez, M. J. et al. (1997) Nat. Genet. 15: 146–156). The humanized antibodies can be prepared by recombination of the. hypervariable region of a monoclonal antibody (Methods in Enzymology (1991) 203: 99–121).

The use of the amino acid sequences of the polypeptides encoded by the cDNAs of the present invention enables predicting that the polypeptides have the following functions. It can be predict, from the results of homology search of SwissProt, GenBank, UniGene, or nr, that these polypeptides have such functions. Specifically, for instance, as shown in Examples, searching for a known gene or polypeptide that is homologous to the partial sequence of the full-length cDNA of the invention (1639 clone) and referring the function of the gene and of the polypeptide encoded by the gene make it possible to predict the function of the polypeptide encoded by the cDNA of the invention. In this way, each of 892 clones out of the 1639 full-length cDNA clones of the invention was predicted to encode a polypeptide that was classified into the following categories.

Secretory and/or membrane protein (439 clones)
Glycoprotein-related protein (87 clones)
Signal transduction-related protein (46 clones)
Transcription-related protein (140 clones)
Disease-related protein (219 clones)
Enzyme and/or metabolism-related protein (168 clones)
Cell division—and/or cell proliferation-related protein (23 clones)
Cytoskeleton-related protein (60 clones)
Nuclear protein and/or RNA synthesis-related protein (59 clones)
Protein synthesis—and/or transport-related protein (24 clones)
Cellular defense-related protein (6 clones)
Development and/or differentiation-related protein (19 clones)
DNA—and/or RNA-binding protein (158 clones)
ATP—and/or GTP-binding protein (63 clones)

The functions of the polypeptides encoded by the cDNAs of the present invention can be predicted by assessing the presence of signal sequence, transmembrane region, nuclear translocation signal, glycosylation signal, phosphorylation site, and zinc finger motif, SH3 domain, etc. in the amino acid sequences. The programs, PSORT (Nakai K., and Kanehisa M. (1992) Genomics 14: 897–911), SOSUI (Hirokawa T. et al. (1998) Bioinformatics 14: 378–379) (Mitsui Knowledge Industry), and MEMSAT (Jones D. T., Taylor W. R., and Thornton J. M. (1994) Biochemistry 33: 3038–3049) can be used to predict the existence of the signal sequence or transmembrane region. Alternatively, a partial amino acid sequence of the polypeptide is fused with another polypeptide such as GFP, the fusion polypeptide is transfected into cultured cells, and the localization is analyzed to predict the function of the original polypeptide.

Based on the determined nucleotide sequences of the full-length cDNAs obtained in the present invention, it is possible to predict more detailed functions of the polypeptides encoded by the cDNA clones, for example, by searching the databases such as GenBank, Swiss-Prot, UniGene, and nr for homologies of the cDNAs; or by searching the amino acid sequences deduced from the full-length cDNAs for signal sequences by using software programs such as PSORT, for transmembrane regions by using software programs such as SOSUI or for motifs by using software programs such as Pfam and PROSITE. As a matter of course, the functions are often predictable by using partial sequence information (preferably 300 nucleotides or more) instead of the full-length nucleotide sequences. However, the result of the prediction by using partial nucleotide sequence does not always agree with the result obtained by using full-length nucleotide sequence, and thus, it is needless to say that the prediction of function is preferably performed based on the full-length nucleotide sequences.

GenBank, Swiss-Prot, UniGene and nr databases were searched for homologies of the full-length nucleotide sequences of the 1639 clones (see Example 6) The amino acid sequences deduced from the full-length nucleotide sequences were searched for functional domains by PSORT, SOSUI and Pfam. Prediction of functions of polypeptides encoded by the clones and the categorization thereof were performed based on these results obtained. The categorization was carried out by the following method.

[1] Firstly, the cDNA clones were classified into the above-mentioned 14 functional categories based on the results of annotation-based categorization (using the keywords in the case of Swiss-Prot hit data; using Definition or Reference information in the case of GenBank, UniGene, or nr hit data) and the signal sequence search of the deduced ORFs by PSORT and the transmembrane region search by SOSUI.

[2] Secondly, clones which had been unassignable to the categories by the method of [1] were searched for functional domains and/or motifs by Pfam. Based on the results, the clones were additionally classified into the above-mentioned 14 types of categories when they had a functional domain and/or motif assignable to any one of the categories.

The following 439 clones presumably belong to secretory and/or membrane proteins.

3NB6910000180, 3NB6910000850, 3NB6920000290, 3NB6920003300, 3NB6920005450, 3NB6920010020, ADRGL10000180, ADRGL10001600, ADRGL20003230, BGGI120010970, BNGH410000340, BNGH410001040, BNGH410001180, BNGH410001370, BNGH410001980, BRACE10000730, BRACE10001690, BRACE20002800, BRACE20007180, BRACE20010650, BRACE20011170, BRACE20011430, BRACE20013400, BRACE20013520, BRACE20014230, BRACE20014530, BRACE20014920, BRACE20015080, BRACE20018590, BRACE20022270, BRACE20024680, BRACE20026350, BRACE20026850, BRACE20030780, BRACE200311.00, BRACE20034490, BRACE20071380, BRACE20071970, BRACE20072810, BRACE20074010, BRACE20074470, BRACE20075020, BRACE20075380, BRACE20076410, BRACE20076630, BRACE20076850, BRACE20077610, BRACE20077640, BRACE20077980, BRACE20078680, BRACE20079530, BRACE20084430, BRACE20086550, BRACE20089600, BRACE20091880, BRAWH10000010, BRAWH10000370, BRAWH10000940, BRAWH10001620, BRAWH10001800, BRAWH20001090, BRAWH20004430, BRAWH20006970, BRAWH20009840, BRAWH20011290, BRAWH20011410, BRAWH20011660, BRAWH20014380, BRAWH20014840, BRAWH20015030, BRAWH20036930, BRAWH20038320, BRAWH20040950, BRAWH20052250, BRAWH20059980, BRAWH20087060, BRAWH20092610, CD34C20000510, CTONG20013660, CTONG20015330, CTONG20028160, CTONG20037820, CTONG20047160, DFNES20003350, FCBBF10006180, FCBBF10006750, FCBBF20005910, FCBBF20007330, FCBBF20008150, FCBBF20009400, FCBBF20015380, FEBRA20003780, FEBRA20004040, FEBRA20004150, FEBRA20004520, FEBRA20004910, FEBRA20006560, FEBRA20006900, FEBRA20007330, FEBRA20008090, FEBRA20008800, FEBRA20010930, FEBRA20012270, FEBRA20012450, FEBRA20012940, FEBRA20013510, FEBRA20014870, FEBRA20014920, FEBRA20015840, FEBRA20020860, FEBRA20021910, FEBRA20025250, FEBRA20031550, FEBRA20037070, FEBRA20041100, FEBRA20041910, FEBRA20057780, FEBRA20063150, FEBRA20066670, FEBRA20067930, HCASM10000610, HCASM20002020, HEART20000990, HEART20004920, HHDPC20000950, HLUNG10000240, HLUNG10000370, HLUNG10001100, HLUNG20001160, HLUNG20001250, HLUNG20001420, HLUNG20001760, HLUNG20002550, HSYRA20003470, HSYRA20006290, HSYRA20008280, HSYRA20011030, HSYRA20013320, HSYRA20014200, HSYRA20015800, IMR3210000440, IMR3210001580, IMR3210002660, IMR3220007750, IMR3220008590, IMR3220009840, IMR3220014350, KIDNE10000080, KIDNE10001040, KIDNE10001430,

KIDNE20000700, KIDNE20000850, KIDNE20001670, KIDNE20003150, KIDNE20003300, KIDNE20003490, KIDNE20004220, KIDNE20005170, KIDNE20005190, KIDNE20033050, KIDNE20033570, KIDNE20039410, KIDNE20042620, KIDNE20042950, KIDNE20044110, KIDNE20048280, KIDNE20049810, KIDNE20054000, KIDNE20054770, KIDNE20060530, KIDNE20060620, KIDNE20063530, KIDNE20063760, KIDNE20066520, KIDNE20067600, KIDNE20071860, KIDNE20073520, KIDNE20074220, KIDNE20075690, LIVER10000580, LIVER10000670, LIVER10001040, LIVER10001110, LIVER10001750, LIVER10005420, LIVER20004160, MAMGL10000320, MAMGL10001840, MESAN10000350, MESAN10001470, MESAN10001800, MESAN20001490, NB9N420000420, NHNPC20002060, NT2NE10000230, NT2NE10000830, NT2NE10001630, NT2NE20003270, NT2NE20003920, NT2NE20004550, NT2NE20004700, NT2NE20005500, NT2NE20012470, NT2NE20014350, NT2NE20016260, NT2NE20034080, NT2NE20047160, NT2NE20055170, NT2NE20057200, NT2RI20005970, NT2RI20009740, NT2RI20010100, NT2RI20014490, NT2RI20015400, NT2RI20015950, NT2RI20016570, NT2RI20018660, NT2RI20020220, NT2RI20021520, NT2RI20022430, NT2RI20022520, NT2RI20025300, NT2RI20030110, NT2RI20030510, NT2RI20031540, NT2RI20033010, NT2RI20033830, NT2RI20036780, NT2RI20042840, NT2RI20044420, NT2RI20049850, NT2RI20050870, NT2RI20051500, NT2RI20066820, NT2RI20068250, NT2RI20070480, NT2RI20070840, NT2RI20073030, NT2RI20074980, NT2RI20077540, NT2RI20078270, NT2RI20080500, NT2RI20081880, NT2RI2.0084810, NT2RI20085980, NT2RI20089420, NT2RI20092890, NT2RI20094060, NT2RP60000320, NT2RP60000390, NT2RP60001090, NT2RP70000690, NT2RP70002380, NT2RP70002590, NT2RP70003640, NT2RP70011660, NT2RP70015910, NT2RP70021510, NT2RP70023760, NT2RP70023790, NT2RP70026190, NT2RP70029820, NT2RP70040800, NT2RP70043730, NT2RP70047900, NT2RP70049250, NT2RP70055200, NT2RP70064080, NT2RP70071540, NT2RP70071770, NT2RP70073810, NT2RP70074220, NT2RP70075040, NT2RP70076170, NT2RP70079250, NT2RP70079750, NT2RP70081330, NT2RP70081370, NT2RP70083150, NT2RP70085500, NT2RP70090120, NT2RP70091490, NT2RP70091680, NT2RP70092360, NT2RP70093220, NT2RP70093730, NT2RP70094290, NT2RP70094810, NT2RP70094980, NT2RP70095070, NTONG10000980, NTONG10002140, NTONG10002570, NTONG20002650, NTONG20004920, NTONG20008000, NTONG20012220, OCBBF10000420, OCBBF20002310, OCBBF20009980, OCBBF20012100, PANCR10000210, PLACE50000670, PLACE50000680, PLACE50001050, PLACE50001130, PLACE60012810, PLACE60018860, PLACE60020160, PLACE60020840, PLACE60026990, PLACE60037050, PLACE60037450, PLACE60043960, PLACE60044540, PLACE60047380, PLACE60049930, PLACE60050290, PROST10002200, PROST10002720, PROST10005260, PROST10005360, PROST20000360, PROST20026820, PROST20029600, PROST20032320, PROST20033020, PROST20039220, PROST20044160, PROST20051430, PROST20054260, PROST20058800, PROST20059190, PROST20059430, PROST20069880, PROST20072370, PROST20073890, PUAEN10000570, PUAEN10003220, SALGL10001570, SKMUS20007740, SKNMC10000190, SKNMC10000290, SKNMC10002290, SKNMC10002510, SKNMC20011130, SKNMC20015030, SMINT10000160, SMINT10000420, SMINT10000570, SMINT10001180, SMINT20000180, SMINT20002770, SPLEN10000910, SPLEN20001340, SPLEN20002430, SPLEN20002700, SPLEN20003100, SPLEN20004960, STOMA10000520, STOMA10001170, STOMA20000320, STOMA20002570, SYNOV20001770, SYNOV20016480, TESTI10000420, TESTI10000960, TESTI10001270, TESTI10001380, TESTI20001770, TESTI20006000, TESTI20007620, TESTI20008830, TESTI20009090, TESTI20009700, TESTI20011340, TESTI20012370, TESTI20013520, TESTI20014200, TESTI20016210, TESTI20016710, TESTI20018520, TESTI20018620, TESTI20020020, TESTI20020810, TESTI20022510, TESTI20024230, TESTI20024650, TESTI20024670, TESTI20025800, TESTI20026320, TESTI20026980, TESTI20027000, TESTI20027070, TESTI20028660, TESTI20030370, TESTI20031930, TESTI20034190, TESTI20036490, TESTI20039980, TESTI20042870, TESTI20047120, TESTI20049940, TESTI20056900, TESTI20057420, TESTI20058600, TESTI20067740, TESTI20069780, TESTI20074800, TESTI20077490, TESTI20079510, TESTI20080200, TESTI20081440, TESTI20087740, TESTI20088470, TESTI20136910, THYMU10000830, THYMU10001760, THYMU10003290, THYMU10003820, THYMU10005580, TRACH10000630, TRACH10001000, TRACH10001400, TRACH20001850, TRACH20001960, TRACH20004200, TRACH20004960, TRACH20006650, TRACH20007670, TRACH20008980, TRACH20015920, UMVEN20001330, UTERU10000770, UTERU10000960, UTERU10001920, UTERU20000470, UTERU20003930, UTERU20004850

The following 87 clones presumably belong to glycoprotein-related proteins.
BNGH410000340, BNGH410001180, BRACE20014920, BRACE20015080, BRACE20018590, BRACE20024680, BRACE20026350, BRACE20031100, BRACE20074470, BRAWH10000370, BRAWH20001090, BRAWH20011660, BRAWH20014840, BRAWH20059980, CD34C20000510, CTONG20013660, CTONG20028160, CTONG20037820, FCBBF20007330, FEBRA20007330, FEBRA20008800, FEBRA20014920, FEBRA20015840, FEBRA20057780, HEART20005060, HLUNG10001100, HLUNG20002550, HSYRA20013320, IMR3210002660, IMR3220007750, IMR3220013320, KIDNE20044110, KIDNE20063760, KIDNE20067600, KIDNE20073520, LIVER20000370, MESAN10000350, NT2NE10000830, NT2NE10001850, NT2NE20003270, NT2NE20016260, NT2RI20018660, NT2RI20025300, NT2RI20036780, NT2RI20077540, NT2RI20080500, NT2RI20085980, NT2RI20089420, NT2RI20092890, NT2RP70000690, NT2RP70004770, NT2RP70055200, NT2RP70081370, NT2RP70083150, NT2RP70091490, NT2RP70092360, NT2RP70094980, NTONG10002140, OCBBF20002310, OCBBF20002770, PLACE50000680, PLACE50001130, PLACE60018860, PLACE60044540, PROST20018230, PROST20032320, PROST20073890, SALGL10001570, SKNMC20015030, SMINT10000160, SMINT20002770, SPLEN20001340, TESTI10001270, TESTI10001380, TESTI20001770, TESTI20024230, TESTI20027070, TESTI20036490, TESTI20039980, TESTI20056900, TESTI20057420, TESTI20079510, THYMU10001760, TRACH10000740, TRACH10001250, TRACH20004200, UTERU20000470

The following 46 clones presumably belong to signal transduction-related proteins.
ADRGL20000740, ASTRO10000180, BRACE20005770, BRACE20022020, BRACE20027360, BRACE20027920, BRAWH20006860, CTONG20005890, FEBRA20000350, HHDPC20000550, IMR3220003020, KIDNE20033730, KIDNE20040840, KIDNE20053360, KIDNE20062990, NT2RI20033440, NT2RI20058110, NT2RI20062100, NT2RI20073840, NT2RP70006240, NT2RP70043960, NT2RP70046870, NT2RP70061880, NT2RP70072520, NT2RP70081440, NT2RP70093700, NTONG10001820, PEBLM20004790, PLACE60026680, PROST20033400, PROST20043320, SKMUS10000220, SKMUS20016680, SPLEN20003570, TESTI20001540, TESTI20005910, TESTI20022560, TESTI20024980, TESTI20029120, TESTI20034980, TESTI20049820, TESTI20055840, THYMU10003590, THYMU20003690, TRACH20002500, TRACH20002890

The following 140 clones presumably belong to transcription-related proteins.
3NB6920010220, 3NB6920015110, 3NB6920015570, ADRGL10000650, BGGI120006840, BGGI120006930, BGGI120017140, BNGH410000800, BNGH420005320, BRACE10000930, BRACE20014550, BRACE20018550, BRACE20020910, BRACE20024090, BRACE20071740, BRAWH10000020, BRAWH10001640, BRAWH10001680, BRAWH20006330, BRAWH20009010, CTONG20025580, CTONG20028200, FCBBF10005980, FCBBF20000940, FCBBF20009510, FCBBF50002610, FEBRA20003970, FEBRA20003990, FEBRA20004540, FEBRA20009720, FEBRA20011460, FEBRA20017150, FEBRA20050140, FEBRA20064760, FEBRA20067360, FEBRA20069420, FEBRA20072800, HLUNG10000760, HLUNG20000680, HSYRA10001370, HSYRA20016310, IMR3210002420, IMR3220007420, KIDNE20000510, KIDNE20039940, KIDNE20061490, KIDNE20078110, NESOP10000870, NHNPC10001240, NHNPC20002120, NT2NE20002590, NT2NE20008090, NT2RI20003410, NT2RI20004120, NT2RI20004210, NT2RI20010830, NT2RI20018460, NT2RI20025410, NT2RI20025850, NT2RI20060710, NT2RI20067350, NT2RI20071330, NT2RI20074390, NT2RI20078790, NT2RI20087140, NT2RI20090650, NT2RI20092150, NT2RP60001000, NT2RP60001270, NT2RP70002710, NT2RP70008120, NT2RP70018560, NT2RP70024500, NT2RP70032030, NT2RP70036290, NT2RP70042040, NT2RP70045410, NT2RP70046560, NT2RP70055130, NT2RP70061620, NT2RP70062960, NT2RP70064940, NT2RP70069860, NT2RP70075370, NT2RP70085570, NT2RP70087200, NT2RP70090190, NTONG20003340, NTONG20003630, NTONG20015500, OCBBF20011010, OCBBF20011240, OCBBF20015860, PEBLM20002480, PEBLM20002700, PEBLM20003080, PEBLM20003950, PLACE60002050, PLACE60005550, PLACE60021510, PLACE60030380, PROST20018230, PROST20031170, PROST20073170, PUAEN10001610, SALGL10000650, SKMUS10000640, SKMUS20014920, SKNMC20000650, SKNMC20002240, SKNMC20003560, SMINT10001000, SMINT20005450, SPLEN20000200, SPLEN20000720, SYNOV20010140, SYNOV20013740, SYNOV20014510, TESTI10000550, TESTI20001200, TESTI20007070, TESTI20010490, TESTI20015560, TESTI20018150, TESTI20018790, TESTI20021490, TESTI20026760, TESTI20027890, TESTI20030710, TESTI20034130, TESTI20042290, TESTI20053960, TESTI20074640, TESTI20074660, TESTI20078640, THYMU10004590, TRACH20000790, TRACH20002370, TRACH20009440, UTERU10001600

The following 219 clones presumably belong to disease-related proteins.
ADRGL10000020, ADRGL10001600, ADRGL20000740, ASTRO20004170, BGGI120006840, BGGI120010970, BGGI120017140, BNGH410001770, BNGH420005320, BRACE10001870, BRACE20006980, BRACE20007180, BRACE20014550, BRACE20018550, BRACE20018590, BRACE20027550, BRACE20027720, BRACE20076850, BRACE20086550, BRAWH10000020, BRAWH10001640, BRAWH20001770, BRAWH20005030, BRAWH20005220, BRAWH20006330, BRAWH20006860, BRAWH20009840, BRAWH20011660, CD34C20000510, CTONG20005890, CTONG20019110, CTONG20024180, CTONG20025580, CTONG20037820, CTONG20055530, FCBBF20000940, FCBBF20009510, FCBBF40002820, FEBRA20001050, FEBRA20003990, FEBRA20004150, FEBRA20004540, FEBRA20009720, FEBRA20010930, FEBRA20011460, FEBRA20050790, FEBRA20057880, FEBRA20064760, FEBRA20067930, FEBRA20070170, FEBRA20075510, FEBRA20075660, HCASM20002140, HEART20004480, HLUNG10001050, HLUNG20000680, HSYRA10001370, HSYRA20006400, HSYRA20013320, HSYRA20016310, IMR3210000440, IMR3220007910, KIDNE10001040, KIDNE20003150, KIDNE20033730, KIDNE20042950, KIDNE20044110, KIDNE20050420, KIDNE20059080, KIDNE20063760, KIDNE20078110, LIVER10002300, LIVER10004330, LIVER20000330, LIVER20000370, MAMGL10001780, MESAN10001800, MESAN20002910, MESAN20005010, NB9N410001350, NHNPC10000840, NHNPC20002120, NT2NE10000730, NT2NE20002990, NT2NE20003690, NT2NE20005170, NT2NE20005360, NT2NE20006580, NT2NE20008090, NT2NE20013720, NT2NE20016340, NT2NE20055170, NT2RI20004120, NT2RI20004210, NT2RI20010910, NT2RI20014500, NT2RI20020410, NT2RI20029580, NT2RI20031540, NT2RI20033440, NT2RI20041900, NT2RI20056470, NT2RI20057230, NT2RI20067030, NT2RI20070960, NT2RI20074980, NT2RI20077540, NT2RI20080500, NT2RI20083960, NT2RI20084810, NT2RI20092150, NT2RI20092890, NT2RP60000350, NT2RP60001000, NT2RP60001230, NT2RP70000690, NT2RP70004250, NT2RP70028750, NT2RP70029060, NT2RP70032030, NT2RP70036290, NT2RP70042600, NT2RP70046560, NT2RP70049250, NT2RP70055020, NT2RP70062960, NT2RP70063040, NT2RP70065270, NT2RP70069860, NT2RP70071770, NT2RP70073810, NT2RP70074220, NT2RP70075370, NT2RP70079250, NT2RP70081440, NT2RP70090120, NT2RP70090190, NT2RP70093220, NT2RP70094980, NTONG10002460, NTONG20003630, NTONG20015500, OCBBF10001180, OCBBF20008240, PEBLM10000340, PEBLM20002480, PEBLM20003080, PEBLM20003950, PLACE50000800, PLACE60002050, PLACE60003790, PLACE60014430, PROST10001670, PROST10005360, PROST20002730, PROST20032320, PROST20033400, PROST20062600, PROST20072890, PROST20073890, PROST20085160, SALGL10001570, SKMUS10000140, SKMUS10001180, SKMUS10001290, SKMUS20000740, SKMUS20003900, SKMUS20007240, SKMUS20016340, SKNMC10002510, SKNMC20000650, SKNMC20003220, SMINT10000420, SMINT10000570, SMINT10001000, SMINT10001030, SMINT20004000, SPLEN10001430, SPLEN20001970, STOMA20000880, STOMA20003960, SYNOV20013740, SYNOV20014510, SYNOV20016480, TESTI10001270, TESTI10001310, TESTI20001200, TESTI20001770, TESTI20002530, TESTI20006000, TESTI20006990, TESTI20007620, TESTI20008830, TESTI20011800, TESTI20012690, TESTI20015120, TESTI20018520, TESTI20018790, TEST120021490, TESTI20025160, TESTI20027070, TESTI20027290, TESTI20029120, TESTI20033250, TESTI20049820, TESTI20053960, TESTI20068660, TESTI20071830, TESTI20074640, TESTI20079510, TESTI20086570, TESTI20140360, THYMU10000830, THYMU10001760, THYMU10003590, THYMU10004910, TRACH20002370, UTERU10000960, UTERU20000470

The following 168 clones presumably belong to the category of enzymes and/or metabolism-related proteins.
3NB6920002810, ADRGL10001600, ADRGL10001650, BGGI120005330, BNGH410000340, BNGH410001770, BRACE10000420, BRACE20015080, BRACE20022020, BRACE20024680, BRACE20026850, BRACE20027360, BRACE20027720, BRACE20027920, BRACE20071380, BRACE20084430, BRAWH20001770, BRAWH20006510, BRAWH20006860, BRAWH20009840, BRAWH20011660, BRAWH20014180, BRAWH20014840, BRAWH20036890, BRAWH20059980, BRAWH20069890, BRAWH20089560, CTONG20013660, CTONG20019110, DFNES20002120, FCBBF20007330, FCBBF20015380, FEBRA20000350, FEBRA20001290, FEBRA20003110, FEBRA20024420, FEBRA20041100, FEBRA20045920, FEBRA20050790, FEBRA20052160, FEBRA20062700, FEBRA20063150, HEART20000350, HHDPC20000550, HHDPC20004550, HLUNG10001050, HLUNG20002550, HSYRA10001680, HSYRA20005100, HSYRA20015740, IMR3220008380, IMR3220009190, IMR3220012180, IMR3220013170, KIDNE20000410, KIDNE20003490, KIDNE20004220, KIDNE20005130, KIDNE20033050, KIDNE20040840, KIDNE20046810, KIDNE20056290, KIDNE20060530, KIDNE20063760, KIDNE20068800, KIDNE20073280, KIDNE20073520, KIDNE20078100, LIVER10000670, LIVER10002300, MAMGL10001780, MESAN20002910, MESAN20005010, NT2NE10000730, NT2NE10001850, NT2NE20002140, NT2NE20003270, NT2NE20003690, NT2NE20005860, NT2NE20013720, NT2NE20016340, NT2NE20016660, NT2RI10000480, NT2RI20010100, NT2RI20015400, NT2RI20020220, NT2RI20025300, NT2RI20033010, NT2RI20036780, NT2RI20037510, NT2RI20051500, NT2RI20068550, NT2RI20073840, NT2RI20074980, NT2RI20084810, NT2RI20087910, NT2RP70004770, NT2RP70006240, NT2RP70011660, NT2RP70026190, NT2RP70062960, NT2RP70072520, NT2RP70076100, NT2RP70081440, NT2RP70084060, NT2RP70085570, NT2RP70093700, NTONG10001820, OCBBF20008240, OCBBF20012100, OCBBF20014080, OCBBF20014940, PANCR10000210, PEBLM20004790, PLACE50001050, PLACE50001130, PLACE60003790, PLACE60012810, PLACE60018860, PLACE60044540, PROST20031170, PROST20032320, PROST20033400, PROST20051210, PROST20064500, SKMUS10001290, SKMUS10001770, SKMUS20000740, SKMUS20007240, SKMUS20008630, SKMUS20009330, SKMUS20011290, SKNSH10001740, SKNSH20003470, SMINT10000160, SPLEN20001340, STOMA10001860, STOMA20001210, STOMA20004820, SYNOV20016480, TESTI10000700, TESTI10001380, TESTI20001540, TESTI20005910, TESTI20012690, TESTI20018270, TESTI20022560, TESTI20027070, TESTI20029120, TESTI20034190, TESTI20034980, TESTI20040000, TESTI20042070, TESTI20042950, TESTI20047120, TESTI20049820, TESTI20138320, TESTI20140360, TESTI30000020, THYMU10000830, THYMU10004910, THYMU20003170, THYMU20003690, TRACH20000150, TRACH20004720, TRACH20004970, TRACH20009260, UTERU10000960

The following 23 clones presumably belong to the category of cell division- and/or cell proliferation-related proteins.
BGGI120001610, BRACE20027550, BRACE20076850, BRAWH20005030, BRAWH20005220, FEBRA20075660, HCASM20002140, HLUNG10000640, IMR3220009730, NT2NE20003840, NT2RI20006850, NT2RI20041900, NT2RI20058110, NTONG10002460, NTONG20008780, SKMUS20016340, SKNMC20003220, SPLEN10001430, TESTI10001680, TESTI20001840, TESTI20021050, TESTI20035120, TESTI20057310

The following 60 clones presumably belong to the category of cytoskeleton-related proteins.
ADRGL10000020, BRACE20006980, BRACE20008850, BRACE20027960, BRACE20074470, BRACE20076630, BRACE20078820, BRACE20093070, BRAWH20000480, BRAWH20066220, CTONG20019550, CTONG20028160, CTONG20055530, DFNES20002680, FCBBF20005910, FEBRA20007720, FEBRA20008810, FEBRA20034290, FEBRA20043290, FEBRA20072000, HEART20004480, HEART20005200, HLUNG10001100, HSYRA20006050, IMR3220007910, KIDNE20040840, KIDNE20052960, NT2RI20014090, NT2RI20032220, NT2RI20058510, NT2RI20090660, NT2RP70000690, NT2RP70004250, NT2RP70028750, NT2RP70042600, NT2RP70049250, NT2RP70074220, NTONG20009660, OCBBF20011760, OCBBF20015280, PEBLM10000680, PROST10001670, PROST20033380, TESTI10000420, TESTI10000510, TESTI20003560, TESTI20004350, TESTI20006000, TESTI20006990, TESTI20008490, TESTI20008830, TESTI20011410, TESTI20015110, TESTI20016610, TESTI20020570, TESTI20024230, TESTI20031090, TESTI20031170, TESTI20039140, TESTI20078720

The following 59 clones presumably belong to the category of nuclear proteins and/or RNA synthesis-related proteins.
3NB6920002810, 3NB6920015280, BGGI120005440, BRACE10001150, BRACE20024780, BRACE20027550, BRAWH20005030, BRAWH20014180, BRAWH20069890, CTONG20024180, FEBRA20001290, FEBRA20075660, HEART20003090, HLUNG10000640, HSYRA10001680, HSYRA20005100, IMR3220008630, IMR3220012180, MAMGL10001780, NT2NE10001850, NT2NE20002140, NT2NE20003840, NT2NE20016660, NT2NE20054410, NT2RI20002820, NT2RI20006850, NT2RI20010910, NT2RI20025540, NT2RI20041900, NT2RI20053350, NT2RI20057230, NT2RI20060720, NT2RI20067030, NT2RI20068550, NT2RI20078840, NT2RI20087490, NT2RP70004770, NT2RP70013060, NT2RP70076430, NTONG20008780, PEBLM10000340, PLACE50000580, PLACE60003790, PROST20001760, PROST20062600, SKMUS10000220, SKMUS20016340, SKNMC20003220, SPLEN10001430, SPLEN20001970, TESTI10001680, TESTI20002530, TESTI20007840, TESTI20021050, TESTI20029120, TESTI20035120, TESTI20057310, TRACH20003930, TRACH20012890

The following 24 clones presumably belong to the category of protein synthesis- and/or protein transport-related proteins.
BRACE20078680, FEBRA20075510, IMR3220008380, KIDNE20005190, KIDNE20050420, MESAN20002910, NB9N410001350, NT2NE20005360, NT2RI20032050, NT2RI20032220, NT2RP70000760, NT2RP70076430, NT2RP70093940, OCBBF20008240, PLACE50000580, PROST20000530, SKMUS20000740, SKMUS20008630, TESTI20007840, TESTI20015120, TESTI20018690, TESTI20078720, THYMU10005580, UMVEN20001330

The following 6 clones presumably belong to the category of cellular defense-related proteins.
BRACE20014550, NT2RI20037510, NT2RI20053350, NT2RP70029060, NT2RP70062960, PLACE50001700

The following 19 clones presumably belong to the category of development and/or differentiation-related proteins.
BGGI120006930, CTONG20028200, FCBBF50002610, FEBRA20014920, FEBRA20017150, FEBRA20060920, MAMGL10001820, NESOP10000870, NHNPC10001240, NT2RI20078790, NT2RP70008120, NT2RP70018560, NT2RP70045410, OCBBF20002770, SALGL10000650, SMINT10001000, TESTI10000550, TESTI20026760, TESTI20078140

The following 158 clones presumably belong to the category of DNA- and/or RNA-binding proteins.
3NB6920002810, 3NB6920010220, 3NB6920015110, 3NB6920015570, ADRGL10000650, BGGI120006840, BGGI120006930, BNGH410000800, BNGH420005320, BRACE20014550, BRACE20020910, BRACE20024090, BRACE20024780, BRACE20071740, BRAWH10001640, BRAWH10001680, BRAWH20000340, BRAWH20006330, BRAWH20009010, BRAWH20014180, BRAWH20069890, CTONG20025580, CTONG20028200, D30ST20001840, FCBBF10005980, FCBBF20009510, FCBBF50002610, FEBRA20003970, FEBRA20003990, FEBRA20004540, FEBRA20008560, FEBRA20009720, FEBRA20017150, FEBRA20017900, FEBRA20050140, FEBRA20064760, FEBRA20067360, FEBRA20069420, FEBRA20072800, HEART20003090, HLUNG10000760, HSYRA10001370, HSYRA20016310, IMR3210002420, IMR3220007420, IMR3220008630, KIDNE20000510, KIDNE20039940, KIDNE20061490, KIDNE20078110, NESOP10000870, NHNPC10000840, NHNPC10001240, NHNPC20002120, NT2NE20002590, NT2NE20003840, NT2NE20008090, NT2NE20016660, NT2NE20054410, NT2RI20003410, NT2RI20004210, NT2RI20006850, NT2RI20010830, NT2RI20010910, NT2RI20025410, NT2RI20025850, NT2RI20057230, NT2RI20060710, NT2RI20067350, NT2RI20071330, NT2RI20074390, NT2RI20078790, NT2RI20078840, NT2RI20087140, NT2RI20087.490, NT2RI20090650, NT2RP60001000, NT2RP60001270, NT2RP70002710, NT2RP70008120; NT2RP70013060, NT2RP70018560, NT2RP70024500, NT2RP70032030, NT2RP70042040, NT2RP70045410, NT2RP70046560, NT2RP70055130, NT2RP70061620, NT2RP70062960, NT2RP70064900, NT2RP70069860, NT2RP70075370, NT2RP70081670, NT2RP70085570, NT2RP70087200, NT2RP70090190, NTONG20003340, NTONG20008780, NTONG20015500, OCBBF20011010, OCBBF20015860, PEBLM10000340, PEBLM20001120, PEBLM20002700, PEBLM20003080, PLACE60002050, PLACE60005550, PLACE60021510, PLACE60030380, PROST20001760, PROST20003250, PROST20018230, PROST20031170, PROST20062600, PROST20073170, SALGL10000650, SKMUS10000640, SKMUS20014920, SKMUS20016340, SKNMC20000650, SKNMC20002240, SKNMC20003220, SKNMC20003560, SMINT10001000, SMINT20005450, SPLEN10001430, SPLEN20000200, SPLEN20000720, SPLEN20001970, SYNOV20010140, SYNOV20013740, SYNOV20014510, TESTI10000550, TESTI20001200, TESTI20007070, TESTI20010490, TESTI20013450, TESTI20015560, TESTI20018150, TESTI20021050, TESTI20021490, TESTI20026760, TESTI20027890, TESTI20030710, TESTI20033270, TESTI20034130, TESTI20035120, TESTI20053960, TESTI20074640, TESTI20074660, TESTI20078640, THYMU10004590, TRACH20000790, TRACH20002370, TRACH20009440, TRACH20012890, UTERU10001600

The following 63 clones presumably belong to the category of ATP- and/or GTP-binding proteins.
3NB6920002810, BNGH410000390, BRACE20022020, BRACE20028120, BRACE20071380, BRAWH20000480, BRAWH20006860, BRAWH20066220, CTONG20013200, DFNES20002680, FEBRA20043290, FEBRA20052160, FEBRA20072000, FEBRA20075510, HHDPC20000550, HLUNG20001160, HSYRA10001680, HSYRA20005100, HSYRA20006050, KIDNE20040840, MAMGL10001780, MESAN20002910, NB9N410001350, NT2NE20003690, NT2NE20005170, NT2NE20016660, NT2NE20055170, NT2RI20068550, NT2RI20073840, NT2RP70004250, NT2RP70011660, NT2RP70029060, NT2RP70036290, NT2RP70042600, NT2RP70046870, NT2RP70062960, NT2RP70081370, NT2RP70081440, NT2RP70093700, OCBBF20008240, OCBBF20015280, PEBLM20004790, PLACE50001700, PLACE60003790, PROST20018990, PROST20033400, SKMUS20008630, SMINT10000420, TESTI20001540, TESTI20003560, TESTI20005910, TESTI20006950, TESTI20006990, TESTI20008490, TESTI20015110, TESTI20016610, TESTI20022560, TESTI20029120, TESTI20034980, TESTI20042290, TESTI20047120, TESTI20049820, TESTI20057310

Among the clones other than the ones shown above, NTONG10001300 is a clone which was predicted to highly possibly belong to the category of secretory protein and/or membrane protein based on the result of domain search by Pfam. FEBRA20017060, NT2RI20066790, SMINT10000710

The three clones shown above are clones which were predicted to highly possibly belong to the category of glycoprotein-related protein based on the result of domain search by Pfam.
BRACE20080970, BRACE20092120, BRAWH10001300, FEBRA20019890, KIDNE20031850, KIDNE20060140, MESAN20000920, NB9N410000470, NT2RI20071480, NT2RI20078910, NT2RP70088550, NTONG20016120, OCBBF10000910, PROST20094830, SKNSH10003010, SPLEN20002670, TESTI20031960, TESTI20036250, TESTI20037810, TESTI20083870, TESTI20177400

The 21 clones shown above are clones which were predicted to highly possibly belong to the category of signal transduction-related protein based on the result of domain search by Pfam.
3NB6920009120, 3NB6920014710, BRACE10001660, BRACE20083850, BRAWH20004760, BRAWH20012030, CTONG20011390, CTONG20018200, FEBRA20007870, FEBRA20043250, HHDPC20003150, NT2RI10000270, NT2RI20036950, NT2RI20053680, NT2RI20072540, NT2RI20083360, NT2RP70030550, OCBBF20013070, OCBBF20015270, PLACE60046630, PROST10003430, PROST20067370, SKMUS10001040, SKNMC20015960, TESTI20030050, TESTI20033540, TESTI20035890, TESTI20068720, TRACH20004110

The 29 clones shown above are clones which were predicted to highly possibly belong to the category of transcription-related protein based on the result of domain search by Pfam.
BNGH410001900, BRACE20080970, BRACE20092120, BRAWH20093600, FEBRA20003770, FEBRA20024290, HLUNG10000990, KIDNE20004030, MESAN20000920, NB9N420001040, NT2NE10000140, NT2NE20001740, NT2RI20050610, NT2RI20055640, NT2RI20072540, NT2RI20074690, NT2RP60000860, NT2RP70036470, NT2RP70036800, NT2RP70072210, NT2RP70074060, NT2RP70084870, NTONG10001300, NTONG10002640, NTONG20016120, OCBBF10000910, OCBBF10001190, OCBBF20007190, SKMUS20001170, SKMUS20016620, SKNMC20000970, SKNMC20015960, SYNOV10001280, TESTI20002380, TESTI20006270, TESTI20013300, TESTI20031520, TESTI20036250, TESTI20037810, TESTI20064830, TESTI20083870, TRACH20006750, TRACH20016070

The 43 clones shown above are clones which were predicted to highly possibly belong to the category of enzyme and/or metabolism-related protein based on the result of domain search by Pfam.
NT2RI20064120

The 1 clone shown above is a clone which was predicted to highly possibly belong to the category of cell division and/or cell proliferation-related protein based on the result of domain search by Pfam.
BRACE20083800, KIDNE20004970

The 2 clones shown above are clones which were predicted to highly possibly belong to the category of cytoskeleton-related protein based on the result of domain search by Pfam.
3NB6920009120, 3NB6920014710, BRACE10001660, BRACE20083850, BRAWH20004760, BRAWH20012030, BRAWH20064500, CTONG20011390, CTONG20018200, FEBRA20007870, FEBRA20043250, HCASM20003070, HHDPC20003150, NT2RI10000270, NT2RI20036950, NT2RI20053680, NT2RI20072540, NT2RI20083360, NT2RP70012310, NT2RP70030550, NT2RP70036470, OCBBF20013070, OCBBF20015270, PLACE60046630, PROST10003430, PROST20067370, SKMUS10001040, SKNMC20000970, SKNMC20015960, TESTI20030050, TESTI20032280, TESTI20033540, TESTI20035890, TESTI20068720, TRACH20004110

The 34 clones shown above are clones which were predicted to highly possibly belong to the category of DNA- and/or RNA-binding protein based on the result of domain search by Pfam.
NT2RI20064120

The 1 clone shown above is a clone which was predicted to highly possibly belong to the category of ATP- and/or GTP-binding proteins based on the result of domain search by Pfam.

The 185 clones shown below are clones which were unassignable to any of the above-mentioned categories, but have been predicted to have some functions based on homology search using their full-length nucleotide sequences and motif search in their estimated ORFs.
3NB6910001160, ASTRO20004170, BNGH410000030, BNGH410001900, BRACE20005250, BRACE20014770, BRACE20016730, BRACE20017370, BRACE20024310, BRACE20028960, BRACE20077840, BRACE20083850, BRAWH20003230, BRAWH20009440, BRAWH20076050, CTONG20018200, CTONG20027210, CTONG20064490, DFNES20004320, FCBBF10006870, FCBBF20002760, FCBBF20012110, FEBRA20000530, FEBRA20005360, FEBRA20007570, FEBRA20011330, FEBRA20019890, FEBRA20030540, FEBRA20043250, FEBRA20044900, FEBRA20048180, FEBRA20053800, FEBRA20068730, FEBRA20070170, HCASM10000210, HCASM20005360, HHDPC20001150, HHDPC20001490, HLUNG10000990, HSYRA10001190, HSYRA20001350, HSYRA20006400, IMR3220002230, IMR3220014910, KIDNE10001520, KIDNE20003750, KIDNE20004970, KIDNE20005740, KIDNE20031850, KIDNE20043440, KIDNE20056760, KIDNE20059080, KIDNE20060140, KIDNE20060300, KIDNE20067750, LIVER10000790, LIVER10004330, MESAN10001010, MESAN20000920, NB9N410000470, NB9N420001040, NB9N420004950, NT2NE10000180, NT2NE10000630, NT2NE20013370, NT2NE20016970, NT2NE20035690, NT2NE20053710, NT2RI20006690, NT2RI20013420, NT2RI20013850, NT2RI20015190, NT2RI20016210, NT2RI20022700, NT2RI20025170, NT2RI20029260, NT2RI20029580, NT2RI20043040, NT2RI20061830, NT2RI20064120, NT2RI20065060, NT2RI20074690, NT2RI20077230, NT2RI20082210, NT2RI20083960, NT2RI20088120, NT2RP60000080, NT2RP60000350, NT2RP60000720, NT2RP60000860, NT2RP70009060, NT2RP70010800, NT2RP70022430, NT2RP70028290, NT2RP70033040, NT2RP70036320, NT2RP70036800, NT2RP70042330, NT2RP70049150, NT2RP70052050, NT2RP70055020, NT2RP70063040, NT2RP70072210, NT2RP70084410, NT2RP70084870, NTONG10000520, NTONG10001230, NTONG10001300, OCBBF10001220, OCBBF20007190, OCBBF20011400, OCBBF20014020, OCBBF20014940, PEBLM10001440, PEBLM20002130, PLACE50000370, PLACE50000800, PLACE60014430, PLACE60024190, PLACE60033990, PLACE60038500, PLACE60043970, PLACE60044640, PROST20023380, PROST20034720, PROST20067370, PROST20079740, SALGL10000470, SKMUS10000140, SKMUS10001040, SKMUS10001180, SKMUS20001170, SKMUS20003650, SKMUS20003900, SKMUS20004580, SKMUS20009020, SKMUS20009540, SKMUS20010080, SKMUS20011470, SKMUS20015430, SKMUS20016620, SKNMC20000970, SKNMC20015960, SMINT10001030, SMINT20001450, SMINT20003960, SMINT20004000, SPLEN20002670, SYNOV10001280, SYNOV20002910, SYNOV20008200, TESTI10000250, TESTI10000640, TESTI10001310, TESTI10001910, TESTI20000440, TESTI20002070, TESTI20002080, TESTI20014120, TESTI20016650, TESTI20022230, TESTI20022940, TESTI20024610, TESTI20027290, TESTI20030050, TESTI20030590, TESTI20030740, TESTI20035510, TESTI20035740, TESTI20041220, TESTI20052680, TESTI20054080, TESTI20064830, TESTI20065720, TESTI20068660, TESTI20071830, TESTI20078670, TESTI20083870, THYMU10000020, THYMU10002910, TRACH10000300, TRACH20006750, TRACH20007800, TRACH20008940, TRACH20013950

Further, the reason is that a polypeptide does not always belong solely to a single category of the above-described functional categories, and therefore, a polypeptide may belong to any of the predicted functional categories. Besides, additional functions can be found for the clones classified into these functional categories by further analyses.

Since the polypeptide encoded by clones of the invention contains full-length amino acid sequence, it is possible to analyze its biological activity, and its effect on cellular conditions such as cell proliferation and differentiation by expressing the polypeptide as a recombinant polypeptide using an appropriate expression system, injecting the recombinant into the cell, or raising a specific antibody against the polypeptide.

The biological activities of respective polypeptides can be analyzed by the methods as shown below.
Secretory Protein, Transmembrane Protein:
"Ion Channels" (Ed., R. H. Ashley, 1995) of "The Practical Approach Series" (IRL PRESS),
"Growth Factors" (Eds., I. McKay, I. Leigh, 1993),
"Extracellular Matrix" (Eds., M. A. Haralson, J. R. Hassell, 1995);

Glycoprotein-Related Protein:
"Glycobiology" (Eds., M. Fukuda, A. Kobata, 1993) of "The Practical Approach Series" (IRL PRESS),
"Glycoprotein Analysis in Biomedicine" (Ed., Elizabeth F. Hounsell, 1993) of "Method in Molecular Biology" (Humana Press) series;
Signal Transduction-Related Protein:
"Signal Transduction" (Ed., G. Milligan, 1992) of "The Practical Approach Series" (IRL PRESS),
"Protein Phosphorylation" (Ed., D. G. Hardie, 1993), or "Signal Transduction Protocols" (Eds., David A. Kendall, Stephen J. Hill, 1995) of "Method in Molecular Biology" (Humana Press) series;
Transcription-Related Protein:
"Gene Transcription" (Eds., B. D. Hames, S. J. Higgins, 1993) of "The Practical Approach Series" (IRL PRESS),
"Transcription Factors" (Ed., D. S. Latchman, 1993);
Enzyme and/or metabolism-related protein:
"Enzyme Assays" (Eds., ROBERT EISENTHAL and MICHAEL J. DANSON, 1992) of "The Practical Approach Series" (IRL PRESS); Cell division and/or cell proliferation-related protein:
"Cell Growth, Differentiation and Senescence" (Ed., GEORGE STUDZINSKI, 2000) of "The Practical Approach Series" (IRL PRESS);
Cytoskeleton-Related Protein:
"Cytoskeleton: Signalling and Cell Regulation" (Eds., KERMIT L. CARRAWAY and CAROLIE A. CAROTHERS CARRAWAY, 2000) of "The Practical Approach Series" (IRL PRESS),
"Cytoskeleton Methods and Protocols" (Ed., Gavin, Ray H., 2000) of "Method in Molecular Biology" (Humana Press) series; Nuclear protein and/or RNA synthesis-related protein:
"Nuclear Receptors" (Ed., DIDIER PICARD, 1999) of "The Practical Approach Series" (IRL PRESS),
"RNA Processing" (Eds., STEPHEN J. HIGGINS and B. DAVID HAMES, 1994);
Protein Synthesis and/or Transport-Related Protein:
"Membrane Transport" (Ed., STEPHEN A. BALDWIN, 2000) of "The Practical Approach Series" (IRL PRESS),
"Protein Synthesis Methods and Protocols" (Eds., Martin, Robin, 1998) of "Method in Molecular Biology" (Humana Press) series;
Cellular Defense-Related Protein:
"DNA Repair Protocols" (Henderson, Daryl S., 1999) of "Method in Molecular Biology" (Humana Press) series,
"Chaperonin Protocols" (Eds., Schneider, Christine, 2000); Development and/or differentiation-related protein:
"Developmental Biology Protocols" (Eds., ROBERT EISENTHAL and MICHAEL J. DANSON, 1992) of "Method in Molecular Biology" (Humana Press) series;
DNA- and/or RNA-Binding Protein:
"DNA-Protein Interactions-Principles and Protocols" (Eds., Kneale, G. Geoff, 1994) of "Method in Molecular Biology" (Humana Press) series,
"RNA-Protein Interaction Protocols" (Eds., Haynes, Susan R., 1999);
ATP- and/or GTP-Binding Protein:
"Signal Transduction Protocols" (Eds., David A. Kendall, Stephen J. Hill, 1995) of "Method in Molecular Biology" (Humana Press) series.

In the categorization, the clone predicted to belong to the category of secretory and/or membrane protein means a clone having hit data with some annotation, such as growth factor, cytokine, hormone, signal, transmembrane, membrane, extracellular matrix, receptor, G-protein coupled receptor, ionic channel, voltage-gated channel, calcium channel, cell adhesion, collagen, connective tissue, etc., suggesting that it was a secretory or membrane protein, or a clone in which the presence of nucleotide sequence encoding a signal sequence or transmembrane region was suggested by the results of PSORT and SOSUI analyses for deduced ORF.

The clone predicted to belong to the category of glycoprotein-related protein means a clone having hit data with some annotation, such as glycoprotein, suggesting that the clone encodes a glycoprotein-related protein.

The clone predicted to belong to the category of signal transduction-related protein means a clone having hit data with some annotation, such as serine/threonine-protein kinase, tyrosine-protein kinase, SH3 domain, SH2 domain, etc., suggesting that the clone encodes a signal transduction-related protein.

The clone predicted to belong to the category of transcription-related protein means a clone having hit data with some annotation, such as transcription regulation, zinc finger, homeobox, etc., suggesting that the clone encodes a transcription-related protein.

The clone predicted to belong to the category of disease-related protein means a clone having hit data with some annotation, such as disease mutation, syndrome, etc., suggesting that the clone encodes a disease-related protein, or a clone whose full-length nucleotide sequence has hit data for Swiss-Prot, GenBank, UniGene, or nr, where the hit data corresponds to genes or polypeptides which have been deposited in the Online Mendelian Inheritance in Man (OMIM), which is the human gene and disease database described later.

The clone predicted to belong to the category of enzyme and/or metabolism-related protein means a clone having hit data with some annotation, such as metabolism, oxidoreductase, E. C. No. (Enzyme commission number), etc., suggesting that the clone encodes an enzyme and/or metabolism-related protein.

The clone predicted to belong to the category of cell division and/or cell proliferation-related protein means a clone having hit data with some annotation, such as cell division, cell cycle, mitosis, chromosomal protein, cell growth, apoptosis, etc., suggesting that the clone encodes a cell division and/or cell proliferation-related protein.

The clone predicted to belong to the category of cytoskeleton-related protein means a clone having hit data with some annotation, such as structural protein, cytoskeleton, actin-binding, microtubles, etc., suggesting that the clone encodes a cytoskeleton-related protein.

The clone predicted to belong to the category of nuclear protein and/or RNA synthesis-related protein means a clone having hit data with some annotation, such as nuclear protein, RNA splicing, RNA processing, RNA helicase, polyaderylation, etc., suggesting that the clone encodes a nuclear protein and/or RNA synthesis-related protein.

The clone predicted to belong to the category of protein synthesis and/or transport-related protein means a clone having hit data with some annotation, such as translation regulation, protein biosynthesis, amino-acid biosynthesis, ribosomal protein, protein transport, signal recognition particle, etc., suggesting that the clone encodes a protein synthesis and/or transport-related protein.

The clone predicted to belong to the category of cellular defense-related protein means a clone having hit data with some annotation, such as heat shock, DNA repair, DNA damage, etc., suggesting that the clone encodes a cellular defense-related protein.

The clone predicted to belong to the category of development and/or differentiation-related proteins means a clone having hit data with some annotation, such as developmental protein, etc., suggesting that the clone encodes a development and/or differentiation-related protein.

The clone predicted to belong to the category of DNA- and/or RNA-binding protein means a clone having hit data with some annotation, such as DNA-binding, RNA-binding, etc.

The clone predicted to belong to the category of ATP- and/or GTP-binding protein means a clone having hit data with some annotation, such as ATP-binding, GTP-binding, etc.

As to a protein involved in a disease, it is possible to perform a functional analysis as described above, but also possible to analyze correlation between the expression or the activity of the protein and a certain disease by using a specific antibody that is obtained by using expressed protein. Alternatively, it is possible to utilize the database OMIM, which is a database of human genes and diseases, to analyze the protein. Further, new information is constantly being deposited in the OMIM database. Therefore, it is possible for one skilled in the art to find a new relationship between a particular disease and a gene of the present invention in the most up-to-date database. The proteins involved in diseases are useful for developing a diagnostic marker or medicines for regulation of their expression and activity, or as a target of gene therapy.

Also, as for a secretory protein, membrane protein, signal transduction-related protein, glycoprotein-related protein, or transcription-related protein, etc., search of the OMIM with the following keywords resulted in the finding that the proteins are involved in many diseases (the result of the OMIM search for secrete and membrane proteins is shown below). Also, association between proteins related to signal transduction or transcription and diseases is reported in "Transcription Factor Research-1999" (Fujii, Tamura, Morohashi, Kageyama, and Satake edit, (1999) Jikken-Igaku Zaukan, Vol. 17, No. 3), and "Gene Medicine" (1999) Vol. 3, No. 2). When cancer is used as an example, as described in "Biology of Cancer" (S. Matsubara, 1992) of Life Science series (Shokabo), many proteins are involved in cancers, which include enzyme and/or metabolism-related proteins, cytoskeleton-related proteins, cell division and/or cell proliferation-related proteins as well as secretory proteins, membrane proteins, signal transduction-related proteins, glycoprotein-related proteins, transcription-related proteins. As clearly seen by the above example, it is evident that not only disease-related proteins but also secretory proteins, membrane proteins, signal transduction-related proteins, glycoprotein-related proteins, transcription-related proteins, etc. are often involved in diseases, and thus they can be useful targets in the field of medical industry.

The result of the OMIM search for secretory and membrane proteins is shown below, in which the keywords,
(1) secretion protein,
(2) membrane protein,
(3) channel, and
(4) extracellular matrix were used.

Shown in the search result are only the accession numbers in the OMIM. Using the number, data showing the relationship between a disease and a gene or protein can be seen. The OMIM data has been renewed everyday.
1) Secretion Protein
354 Entries Found, Searching for "Secretion Protein"
*604667, *104760, *176860, *151675, *139320, *107400, *604029, *118910, #200100, *176880, *603850, *147572, *604028, *179513, *125950, *139250, *246700, *600946, *600560, *602926, 185860, *605083, *603215, *602421, *157147, *179512, *600174, *109270, *604710, *138120, *179510, *600998, *179509, *170280, *179511, *600626, *603831, *601489, *154545, *179490, *603826, *122559, *603216, *102720, *147290, *164160, *603062, *112262, *602672, *605435, *605322, *131230, *601652, *603166, *601746, *601591, *179508, #160900, *104311, *600759, *147545, *167805, #104300, *167770, #219700, *168470, *601684, *602049, *601146, *605227, *602434, *602534, *114840, *603489, *604323, *107470, *600753, *600768, *118825, *600564, *604252, *173120, *134370, *192340, *308230, *600322, *605359, *600046, *300090, 106160, *600041, #262500, *605563, *150390, *158106, *182590, #103580, *104610, #173900, *134797, *143890, #145980, *306900, *308700, *176300, *227500, *137350, #154700, *138079, *600760, *107730, *142410, *147670, *124092, *590050, *152760, *600509, *605646, *201910, *227600, *152790, *300200, *300300, 300800, *138160, *107741, *120150, *601199, *120180, *120160, *176730, *133170, *122560, *107300, *137241, *120140, *101000, *193400, *217000, *272800, *600937, #201710, *600377, #174800, *106100, #274600, *173350, #177170, *147620, *214500, *131244, *202110, *120120, *601007, *191160, *147470, *603372, *600733, *252800, *190160, *138040, *158070, *162151, #125700, #130070, *113811, *603355; *171060, *136435, #184700, *603732, *190180, *164008, *186590, *120220, *604312, *152200, *138130, *605085, *605353, *600840, #166210, *188545, *207750, *173360, *601933, #194050, *153450, *138850, *253200, *307030, *157145, *600514, *600262, *264080, *147380, *600281, #204000, #227810, *232200, *188826, *232800, *161561, #166200, *188400, *153620, *182099, *218040, #265800, *172400, #177200, *176805, #211600, #214700, #176410, *152780, *600633, *601771, *301500, *605402, *601922, *307800, *147892, *147720, *312060, #520000, *147660, *106150, *602358, *107270, *601769, *147440, *604558, *131530, *600270, *601610, *603692, *603401, *600423, *601604, *603345, #125853, *602843, *142640, *603044, *605740, *134830, *602779, *130660, *139191, *137035, *600761, *601340, *600823, *107740, *130160, *600877, *605110, *600945, *130080, *600957, #130050, *605580, *118444, *601124, *124020, 122470, *120700, *603201, *137216, *601185, *138945, *218030, *600839, #240600, #262400, #162300, *162330, *188450, #265850, *263200, *162641, *300159, *601038, #191390, *201810, *601398, *602384, *131240, *602423, *139392, *142703, *602663, *232700, *602682, #602722, *602730, *600734, *188540, *182452, *601538, *603061, *146880, *603140, *603160, *142704, #252650, *182280, *125255, *603252, #131750, *182139, *182100, #259420, #261100, *603493, *601745, *182098, *603795, *123812, *600264, *147940, *180246, *180245, *118888, #604284, *168450, *118455, *604398, *604433, *601919, *118445, *600031, *604961, *605032, *605033, *171050, *171300, *131243, *109160, *605254, 274900, #171400, *600042, *151670, *184600, *605470, *605546, *176760, *602008, *102200, *605720, *600732, *605901

2) Membrane protein
1489 Entries Found, Searching for "Membrane Protein"
*130500, *605704, *305360, *153330, *173610, *109270, *170995, *170993, *104776, *602333, *309060, *605703, *120920, *605943, *602690, *159430, *600897, *133090, *601178, *602413, *602003, *604405, *605940, *603237, *109280, *600378, *602173, *107776, *602334, *602335, *125305, *601134, *309845, *605731, *154045, *603241, *603718, *600594, *603214, *185881, *603657, *600182, *603177, *605331, *601476, *605456, *601114, *605190, *600723, *603904, *136950, *300222, *602879, *185880, *605348, *300096, *602257, *177070, *310200, *603062, *603344, *600039, *602977, *300100, *128240, *600959, *600322, *227400, *186945, *600946, *602534, *602048, *182900, *601097, *600267, *602625, *136430, *602421, *601047, *107450, *143450, *603141, *184756, *164730, *159440, *154050, *600579, *312080, *604202, *603700, *600447, *256540, *604691, *158343, *600403, *602414, *137290, *176640, *176981, *600179, *600754, *604456, *604693, *605875, *604605, *188860, *300172, *602910, *604323, *219800, *601848, *603179, *600279, *602251, #222700, *603831, *605072, *605377, *601028, *604155, *108733, *104225, *601896, *601510, *173335, *107770, *601767, *600046, *603850, *600400, *603784, *603234, 188560, *605863, *121015, *605862, *605861, *186946, *604252, *603215, *142461, *604597, *603143, *605264, *603735, *176860, *605536, *176801, *180721, *603355, *104760, *131560, *310300, *602631, *304700, #309400, *603142, *143890, *605431, *600753, *115501, *176790, *600266, *601691, *168468, *601239, *602216, #104300, *605613, *601595, *605550, *125950, *605475, *602217, *602261, *603534, *602262, *604631, *190315, *601313, *604306, *104311, *604672, *605000, *602461, *605548, *602296, *604376, *121014, *121011, *600691, *604262, *139310, *304040, *605445, *179514, *179512, *151460, #160900, *120130, *128239, *601158, *601403, *176943, *601014, 300800, *300294, *601757, *185470, *273800, *605034, *602887, #185000, *604871, *603593, *603583, *605454, *104775, *605872, *141180, *602713, *603531, *139150, *601531, *601832, *605452, *134651, *604156, *120620, *605883, *604142, *166945, *605324, *600816, *604699, *300112; *605182, *600164, *182180, *605071, *300023, *605057, *308240, *300249, *176947, *176894, *605081, *605035, *602044, *182860, *107271, *305100, *153390, *113730, *602689, *180069, *603518, *300017, *191275, *177061, *601693, *601789, *604241, *600934, *138160, *604424, *603868, *600174, *600718, *600523, *604141, *601009, *605251, *600481, *600874, *155550, *605227, *601017, *162230, 601138, *604157, *601212, *600763, *604110, *604158, *601107, *601326, 600621, *600587, 601137, *600917, *600855, *605058, *194355, *605194, *603291, *102720, *136425, *170715, *603216, *605547, *135630, *602926, *600168, *605002, *602474, *600157, *603025, *603893, *231200, *120090, *601966, *131230, *604722, *604721, *604515, *246700, *602101, *605628, *303630, *605787, *602857, *602285, *605708, *602488, *605025, *603817, *300051, *603293, *176878, *603646, 605707, 185860, *112205, *300187, *602654, *120070, *603648, *604850, *602655, *602514, *300118, *182309, *179590, *602701, *600759, *204200, *604170, *175100, #103580, *147670, *306400, *143100, *182870, *257220, *180380, #116920, *301000, *193300, *157147, *131550, *139200, *139130, *190195, *605406, *155760, *155960, *605734, *155970, *605385, *111700, *155975, *150370, 605709, *151430, *605438, *151510, *116952, *157655, *158105, *605777, *176877, *153619, *120131, *185430, *109190, *120190, .*109170, *605093, *605250, *153432, *107777, *186590, *160993, *605699, *605698, *605813, *605697, *605616, *605300, *162060, *605219, *163970, *135620, *165040, *605478, *604964, *103195, *604932, *604923, *605906, *605496, *605914, *166490, 138277, *604915, *114070, *605213, *605933, *180297, *101000, *191163, *191164, *605101, *603167, *600772, *603164, *600708, *604001, *191328, *313440, *602672, *604009, *604299, *192974, *604256, *603048, *600515, *604221, *602632, *604196, *601179, 603290, *604661, *601023, *601110, *304800, *203200, *300212, *602933, *603352, *208900, *604418, *604838, *600551, #212140, *604837, *602049, *600552, *600553, *300213, *602574, *600583, *600932, *603452, *604775, *516020, *604617, *604464, *603498, *300145, *601523, *602694, *600632, *604762, *604492, *400015, *604504, *601717, *601728, *300242, *602426, *604194, *603821, *604730, *600695, *603823, *603869, *300241, *600707, *603822, *602370, *602202, *604193, *601181, *604089, *602507, *604195, *602306, *300284, *601805, *601895, *601275, *604660, *600752, *603820, *604192, *602207, *308230, *600894, *312600, *603199, *604029, *602500, *102680, *235200, #256300, *601633, #219700, 262890, *156225, *173470, *193400, *173910, *600354, *113705, *600065, *107741, *107400, *600024, *131195, *113811, #118220, *601638, *300011, *276903, *604144, *311770, *601758, #173900; *604592, *120120, *179605, *603130, *603372, *110750, *222900, *602509, *256100, *602469, *602281, *229300, *224100, *110900, *190180, *261600, *602997, *603616, *603189, 601791, *601567, *312700, *171060, *308700, *604027, *162643, *516000, *176261, *604028, *314850, #145980, *601383, *600930, *305900, *601253, *136350, *605537, *138140, *604033, *605070, *139250, *300500, *603967, *300041, *603866, #130600, *120150, *601050, *604942, *605204, *605248, *272750, *600163, *604235, *600682, *107266, *306900, *191092, #262500, *600106, *152790, *186720, *227650, *153700, *308380, *103390, *605646, *164920, *604478, #252650, *173850, *173350, *602505, *246530, *194380, *602575, *603030, #209920, *212138, #214100, *605767, *600582, *189980, #176200, *604653, *604678, *256550, *300037, *253700, #253300, #226700, *604766, #244400, *190000, *188040, *604824, *214500, #237500, *232300, *605014, *604477, *190930, *605124, *604475, *604594, #227810, *306700, *301050, *600135, *600143, *605145, #269920, *300104, *277900, *300135, *300231, *192500, *182138, *191190, *176805, *600185, *186591, *604889, *603051, *165360, *147545, *601040, #156575, *107269, *603009, *602934, *123825, *601081, *602924, *163890, *600381, *602909, *150330, *109690, *123900, *603434, *603491, *110700, *602581, *125647, #154700, *114760, *141900, *603690, *120220, *601199, #145500, *601309, *602382, *120325, *600877, *604205, *604090, *601497, *602377, *605464, *138720, *603728, *120950, *604026, *600580, *601610, *137167, *603960, *603931, *601880, *603126, *138190, *130130, *601997, *601975, *600395, *516040, *600418, *600650, *605245, *605172, *600509, *164761, *310400, *600308, *605109, *600544, *600359, *600103, *605267, *312610, *176100, *308100, *158070, *605123, *173325, #312750, *600839, *158120, #604369, *604465, *173510, #161200, *151525, *605369, *604237, *516050, #600886, *604517, *165180, *605381, *605399, *307800, *604365, *155740, *147795, 601709, *604673, *147730, *602122, *147557, *193245, *600978, *604990, *603261, *603274, *601007, *131100, *602941, *107941, *146710, *276901, *131244, *602872, *603411, *186357, *176290, *601066, *185050, *232200, *143030, *601843, #236700, *604122, *142800, *134638, *604985, *182380, *603930, *142410, *137060,

*604586, *601193, *120650, *252500, *253800, *120930, *604858, *605874, 601274, *602158, *605873, *193210, *203100, *601295, *604095, #201710, *126150, *108740, #205400, *601373, *300167, *109545, *602894, *603361, #300257, *266200, *603401, *131390, *180470, *605908, *604798, #221770, *223360, *180901, *605641, *605745, *604018, *300200, *604603, *230800, *602676, #604004, *605692, *602640, *601599, *134637, *245900, *118425, 601614, *605725, *120110, *300189, *300035, *603102, *250800, *602282, *602458, *123610, *603754, *300278, *601463, *300224, *601581, *182160, *601653, *139191, *601733, *600748, *142460, *601194, *152390, *153620, *601615, *601814, *601617, *601613, *300191, #308300, *600798, 601858, *601872, *601597, #601588, *600821, *147840, *152427, *138850, *600823, *601492, *300256, *600840, *300267, *601411, *139080, *139090, 600851, *300334, *179080, *602095, *601284, *601282, #177200, *601681, *601252, *176000, *602184, *602188, #266510, #154020, *186711, *257200, *601711, *600667, *602241, *186745, *255125, *300126, *600644, *123890, #255120, #175200, *600004, *302060, *123580, *186760, *122561, *602316, *600017, *120940, 140300, *151690, *120700, *602354, *600019, *600857, *182175, *600536, *158380, *600516, *120290, *600493, *182310, #252010, *182530, *186830, *601839, *142790, *159465, *118990, *250790, *248600, #248250, *186845, *601153, *142600, *116930, *114860, *171834, #303600, *186880, *600444, *142871, *601852, *602602, *602607, *114207, *186910, #232220, 600880, *134635, *112203, #112100, *111680, *231680, *311030, *111250, *111200, *134390, #226670, #145600, *226200, *602714, *171760, *133550, *602727, *161555, *602744, *602746, #131705, *602835, *600423, *176267, *602859, #600918, 277175, *602874, *601020, *109770, *600170, *217070, *173515, *602893, *147280, *154360, *171050, *108780, *176257, *600979, *600377, *108360, *204500, *170260, *146880, *154582, *601011, *600997, *602992, *201475, *603005, *190198, *147360, #270400, *600238, #164970, *306250, #126600, *193065, #181350, *106180, *602136, *600937, *603086, *603087, *307030, *182099, *103320, *601683, #192430, *103180, *102681, *192321, *600244, *191740, *191315, *603152, *102642, *191305, #266140, *100500, *600867, *604585, *604404, *604345, *603201, *605430, *603207, *603208, *605433, *604101, *603969, *605896, *604616, *605851, *605768, *604576, *605754, *605730, *605477, *603263, *605538, *603283, *604402, *605453, *605427, *603302, *605458, 603313, *604415, *603345, *605541, *603353, *605295, *603879, *605268, *605266, *605246, *603377, *603380, *605181, *604203, *603425, *603867, *605106, *605017, *603842, *604936., *603510, *604857, *605932, *605816, *603765, *603551, *605357, *605237, *604204, *603594, *605110, *604190, *603861, *604962, *603639, *603644, *605007, *605349, *604943, *604918, *604907, *603667, *603681, *605396, *605561, *603712, *603713, *605688, *605942, *604878, *604843, *604659, *604671 *603798, *604682, *604056, *604705, *603749, 602586, *603647, *602515, #602475, *603717, *602359, *602372, *602380, *602518, *603652, *602573, *603626, 602587, *603598, *602871, *603613, *603750, *603875, *602608, *602666, *602345, *602935, *603564, *603548, *603927, 601876, *602343, *603943, *603787, *601730, *601611, *602679, *603788, *602243, 603790, *601535, *603796, *601488, *601485, *602314, *601478, *604047, *604048, *602297, *604057, *602715, *602192, *601459, *601416, *603833, *602190, *604102, *602106, *604111, *602724, *603499, *602736, *601123, *601002, *600923, *601987, *604149, *601929, *600910, *600900, *600864, *604165, *600782, *602836, *600769, *600742, *602783, *601905, *600535, *604198, *601901, *600534, *602876, *603356, *600530, *604216, *604217, *602890, *602905, *600465, *600464, *600446, *602891, *603366, *601894, *604272, *603926, *603312, *600368, *602914, *600327, *603151, *603202, 602911, *602974, *603006, *601883, *603008, *600074, *603007, *603046, #603903, *604433, *600016, *603925, *516005, *516004, *516003, *601756, *604487, *516001, *313475, *313470, #307810, *604527, *604528, *601745, *604551, *604555, *603243, *603242, *603061, *603063, *603217, *300335, *300283, *300281, *604600, *300197, *603097, *603220, *601625, *604623, *603118, *601590, *604646, *300008, *601568, *300007, *275630, *601533, #275200, *270200, #261550, *604031, *604683, #254800, *251100, #242300, *604058, *604720, *240500, *233690, #232240, #226730, *223100, *222100, #220100, *216950, *604832, 212750, 212067, *604066, *193067, 601315, *193001, *604862, *604870, *191306, *600385, *604879, *191191, *601296, *604914, *190181, *604119, #188550, *604925, *188410, #601287, *604939, *188380, *604126, *604945, *604148, *188060, *604982, *186854, *604988, *186360, *186355, *185250, *600916, *605008, *605009, 185020, *600734, *605024, *182331, *605032, *605033, *182305, *180903, *179800, *179610, *605060, *179410, *178990, *176802, *605080, *176266, *176263, *176260, *600732, *173490, *604199, *173445, *173391, 172290, *605147, *605149, *171890, *600528, *171833, *605185, #170500, *605193, *168000, *605196, *167055, *605205, *605208, 166900, *605216, *162651, *162010, *600504, #161400, *604253, *160800, *159460, *154540, *605254, *605261, *153634, *600429, *153337, *600424, *605292, #604286, #152700, 152423, *152310, *151625, *600153, *604313, *151523, *150325, *150320, *150292, *603150, *150290, *150210, *605410, *605415, *605416, *605417, *605421, *603149, *604349, *147940, *600282, *147880, *146928, *146661, *600150, *146630, *142622, *600018, *605461, *138981, *138590, *600023, *138330, *605495, *138297, *605512, *138230, *136900, #301310, *516006, *605545, *605546, *136131, *134660, *134350, *516002, *605589, *131235, #130050, *605625, *126455, *126064, #125310, *605670, *604534, *125240, *123836, *123830, *123620, *605702, #122200, *120980, *120360, *118510, *114835, *605710, *605716, *605722, *114217, *604561, *113810, *111740, #110800, *605748, *605752, *604564, *110600, *603160, *109610, *605784, #107480, *107273, *603192, *300169, *106195, *105210, *104615, *104614, *104210, *103850, 103581, *605876, *605877, *605879, *103220, *605887, *300150, *102910, *102670, *102576, *605916, *604629, *102575, *102573, *300132, *101800, *605947

3) Channel (Member of Membrane Protein)
361 Entries Found, Searching for "Channel"
*176266, *600724, *182390, *123825, *114208, *114206, *176267, *114205, *601784, *600937, *114204, *603415, *600053, *114207, *114209, *605427, *604527, *604528, *600760, *601011, *192500, *118425, *600228, *176261, *602235, *600761, *600359, *300008, *182389, *600877, *602232, *176263, *182391, *601328, *600054, *603939, *602208, *601534, *600504, *602323, *603208, *601958, *603537, *601012, *601327, *600734, *602780, *602781, *604433, *603220, *182392, *605874, *605873, *601745, *603888, *603219, *602604, *603796, *302910, *602866, *601013, *602905, *602906, *603967, *600163, #170500, *152427, *180901, *176260, #601462, *603951, *601141, *604492, *600702, *602023, *600308, *602754, *107776, *176257, *602024, *601949, *605222, *601142, *602983, *193245, *600681, *176265, *600235, *176262, *176258,

*605206, *604427, *605411, *603305, *601219, *600150, *604065, *602343, *605223, *605720, *603906, *138249, *138253, *600843, *604385, *600003, *600935, *603940, *602727, *602158, 602911, *600397, *602726, *600845, *605080, *600580, *602872, *602106, *176264, *603953, *605722, *300110, *138252, *604111, *602717, *602420, *600570, 600844, *603493, *600932, *605716, *138254, *603652, *300138, *605410, *176268, *605214, *605696, *300334, *604660, *176256, *605879, *603749, *603583, *602345, *604661, *603787, 603313, *602982, *604337, *600846, *604662, *300328, *300281, *602566, *602836, *604003, *603788, *603651, *602421, *107777, #177200, *100725, #219700, *100690, *100710, #160800, #603830, #183086, *600509, #220400, #601144, *173910, *180902, *605692, #264350, #160900, #145600, #255700, *602076, *603061, *601313, *154275, #604233, *604532, #108500, #121201, *170400, *300225, *121014, *139311, #125800, #160120, *118503, 601439, #141500, #168300, *304040, #601887, #256450, *186945, *154276, #300009, #216900, *600040, *601014, *601042, *602512, *601383, *605445, *602368, *603831, #117000, *601218, *108745, *605248, #177735, *173900, *601212, *182139, *601059, *600039, *601485, *180903, *186360, *603319, #600101, *118509, *600109, #121200, *600170, *604187, *176975, *137163, #310468, #263800, #262300, *603750, *600229, *124030, *602251, #603829, *137143, #145500, *600669, *147450, *154050, *603353, *600516, *601157, *600855, *601154, *602522, *249210, *600968, #252650, *171060, *600919, *156490, #259700, #601678, *601764, #310500, *131244, *300041, *121011, *125950, *114180, *602974, *600637, *113730, *118504, *605145, *604669, *118800, *121013, *121015, *138491, *600421, *104610, *604045, *604594, *131230, *605487, *138247, *600467, #602485, *602481, *138251, *137192, *602403, 600851, *27.7900, *603785, *603152, *603199, *603475, #168600, #272120, *170280, *603852, #241200, *603053, *600465, #603034, *142461, *164920, *137164, *600884, *600442, *123885, *604001, *600232, *232200, *171050, *602103, *602014, *300211, *600983, *602887, *604415, *604418, *300242, #300071, *604471, *600837, 168350, *118511, 193007, *600300, *604654, #601820, *180297, *600046, *603853, *604678, *604693, #604772, *118508, *603855, *605204, #254210, *182099, *182307, #130600, *601109, *114080, *300103, *182860, *605438, *601129, *603964, *600019, *516060, #185000, *138079, *104210, *605818, *603418, *305990, *305450

4) Extracellular Matrix
218 Entries Found, Searching for "Extracellular Matrix"*605912, *603479, *602201, *604633, *601418, *601548, *115437, *154870, *600754, *602261, *602285, *602262, *134797, *120361, *604629, *604871, *603321, *603320, *601807, #154700, *116935, *185261, *120360, *185250, *605470, *603767, *253700, *190180, *128239, *308700, *276901, *193300, *120324, *188826, *602109, *155760, *600514, *600261, #177170, *600536, *147557, #116920, *150240, *601313, *120140, 601614, *605158, *120150, *120180, #200610, *605127, *193400, *192240, #173900, *152200, #136900, *135821, #130070, *120320, *120220, *112260, *310200, *600900, *600262, *605670, *600985, *179590, #245150, *602574, *601463, 183850, *601211, *604241, *600758, *186745, *604710, *602369, *602090, *190182, *192975, *602178, *230740, *600065, *601652, *158106, *190181, *156790, #158810, *193210, *155120, *192977, *193065, #226700, *187380, *231050, *182120, *188060, *186355, 163200, *164010, #156550, *151510, *150370, *253800, *156225, *150325, #194050, *150290, *216550, *147620, *600215, *222600, *147559, *165380, *182888, *600491, *146650, *146640, *600564, *600596, *600616, *600700, *600742, *138297, *182889, *154705, *600930, *301870, *153619, *601050, *601090, *601105, *165070, *305370, *135820, *130660, *310300, *601492, *128240, *601587, #126600, *601636, *600119, *601692, *601728, *125485, 601858, *601915, *602048, *175100, *602108, *121010, *600245, *120470, *120328, *120325, *602264, *120280, *602366, *600309, *602402, *602415, *602428, *602453, *602505, #166210, *602600, *602941, *603005, *603196, 603209, *603221, *603234, *603319, *120250, *120210, *120120, *603489, *603551, *118938, *603799, *603842, *603924, *603963, *604042, *604063, *604149, *604160, *601028, *604467, *604510, *604592, *116930, *116806, *601284, *604724, *604806, *604807, *604808, *107269, *605007, *605008, *605009, *600214, *600076, *605174, *605175, *605292, *605343, *605351, #600204, *605497, *605546, *605587, *605623, *600211, *605702, *103320

In addition to these, the various keywords shown in the above-mentioned categorization or others can be used for the OMIM search and the result may suggest the involvement thereof in diseases.

Further, the use of nucleotide sequences of cDNAs of the present invention enables analyzing the expression frequency of genes corresponding to the cDNAs. In addition, functions of the genes can be predicted based on the information obtained by the expression frequency analysis.

There are several methods for analyzing the expression levels of genes involved in diseases. Differences in gene expression levels between diseased and normal tissues are studied by the analytical methods using, for example, Northern hybridization, RT-PCR, DNA microarray, etc. (Experimental Medicine, Vol. 17, No. 8, 980–1056 (1999); Cell Engineering (additional volume) DNA Microarray and Advanced PCR Methods, Muramatsu & Nawa (eds.), Shujunsya (2000)). By computer analysis, in addition to these analysis methods, the nucleotide sequences of expressed genes can be compared to analyze the expression frequency. For example, there is a database called "BODYMAP"; gene clones are extracted at random from cDNA libraries of various tissues and/or cells, and the clones homologous to one another are assigned to a single cluster based on the information of nucleotide sequence homology at the 3'-end; genes are classified into any clusters, and the numbers of clones in the respective clusters are compared to gain the information on expression frequency.

When explicit difference in the expression levels between diseased tissues and normal tissues is observed for a gene by these analytical methods, it can be conclude that the gene is closely involved in a disease or disorder. Instead of diseased tissues, when gene expression is explicitly different between normal cells and cells reproducing disease-associated specific features, it can be concluded that the gene is closely involved in a disease or disorder.

From the 1639 clones whose full-length nucleotide sequences had been revealed, genes involved in particular pathology or functions were selected by the use of databases shown below (see Example 7; "Expression frequency analysis in silico"). The database used in the analyses of the present invention contains nucleotide sequences of 770,546 clones, and the population of the database is large enough for the analysis. The sequence information in the database was obtained by selecting cDNA clones at random from cDNA libraries derived from the various tissues and cells shown in Example 1 and determining the 5'-end sequences thereof.

Then, the nucleotide sequences of respective clones in this database were categorized (clustered) based on the nucleotide sequence homology determined with a search program; the number of clones belonging to every cluster of each library was determined and normalized; thus, the ratio of a certain gene in a cDNA library was determined. This analysis provided the information of the expression frequency of a gene in a tissue or cell that is the source of the cDNA library.

Then, in order to analyze the expression of genes corresponding to the nucleotide sequences of cDNAs of the present invention in tissues and cells, the libraries from the tissues or cells, which had been used in the large-scale cDNA analyses, were taken as subjects to compare the expression levels between different tissues or cells. Namely, the expression frequency was analyzed by comparing the previously normalized values between tissues or cells from which 600 or more cDNA clones whose nucleotide sequences had been analyzed were derived. The result of this analysis showed that the cDNA clones corresponded to the genes involved in the pathology and functions, which are indicated below. Each value in Tables 3 to 39 indicated below represents a relative expression frequency; the higher the value, the higher the expression level.

Osteoporosis-Related Genes

Osteoporosis is a pathology in which bones are easily broken owing to overall decrease in components of bone. The onset correlates to the balance between the functions of osteoblast producing bone and osteoclast absorbing bone, namely bone metabolism. Thus, the genes involved in the increase of osteoclasts differentiating from precursor cells of monocyte/macrophage line (Molecular Medicine 38. 642–648. (2001)) are genes involved in osteoporosis relevant to bone metabolism.

A nucleotide sequence information-based analysis was carried out to identify the genes whose expression frequencies are higher or lower in CD34+ cell (cell expressing a glycoprotein CD34) treated with the osteoclast differentiation factor (Molecular Medicine 38. 642–648. (2001)) than in the untreated CD34+ cell, which is the precursor cell of monocyte/macrophage line. The result of comparative analysis for the frequency between the cDNA libraries prepared from the RNA of CD34+ cells (CD34C) and from the RNA of CD34+ cells treated with the osteoclast differentiation factor (D30ST, D60ST or D90ST) showed that the genes whose expression levels were different between the two were 41 clones indicated in Table 3. These clones are involved in osteoporosis.

Genes Involved in Neural Cell Differentiation

Genes involved in neural cell differentiation are useful for treating neurological diseases. Genes with varying expression levels in response to induction of cellular differentiation in neural cells are thought to be involved in neurological diseases.

A survey was performed for genes whose expression levels are varied in response to induction of differentiation (stimulation by retinoic acid (RA) or growth inhibitor treatment after RA stimulation) in cultured cells of a neural strain, NT2. The result of comparative analysis of cDNA libraries derived from undifferentiated NT2 cells (NT2RM) and the cells subjected to the differentiation treatment (NT2RP, NT2RI or NT2NE) showed that the genes whose expression levels were different between the two were 500 clones indicated in Table 4. These genes are neurological disease-related genes.

Cancer-Related Genes

It has been assumed that, distinct from normal tissues, cancer tissues express a distinct set of genes, and thus the expression thereof can contribute to the carcinogenesis in tissues and cells. Thus, genes whose expression patterns in cancer tissues are different from those in normal tissues are cancer-related genes. Search was carried out for the genes whose expression levels in cancer tissues were different from those in normal tissues.

The result of comparative analysis of cDNA libraries derived from breast tumor (TBAES) and normal breast (BEAST) showed that the genes whose expression levels were different between the two were 11 clones indicated in Table 5.

The result of comparative analysis of cDNA libraries derived cervical tumor (TCERX) and normal cervical duct (CERVX) showed that the genes whose expression levels were different between the two were 10 clones indicated in Table 6.

The result of comparative analysis of cDNA libraries derived from colon tumor (TCOLN) and normal colon (COLON) showed that the genes whose expression levels were different between the two were 5 clones indicated in Table 7.

The result of comparative analysis of cDNA libraries derived from esophageal tumor (TESOP) and normal esophagus (NESOP) showed that the genes whose expression levels were different between the two were 5 clones indicated in Table 8.

The result of comparative analysis of cDNA libraries derived from kidney tumor (TKIDN) and normal kidney (KIDNE) showed that the genes whose expression levels were different between the two were 205 clones indicated in Table 9.

The result of comparative analysis of cDNA libraries derived from liver tumor (TLIVE) and normal liver (LIVER) showed that the genes whose expression levels were different between the two were 35 clones indicated in Table 10.

The result of comparative analysis of cDNA libraries derived from lung tumor (TLUNG) and normal lung (HLUNG) showed that the genes whose expression levels were different between the two were 62 clones indicated in Table 11.

The result of comparative analysis of cDNA libraries derived from ovary tumor (TOVER) and normal ovary (NOVER) showed the genes whose expression levels were different between the two were 7 clones indicated in Table 12.

The result of comparative analysis of cDNA libraries derived from stomach tumor (TSTOM) and normal stomach (STOMA) showed that the genes whose expression levels were different between the two were 41 clones indicated in Table 13.

The result of comparative analysis of cDNA libraries derived from uterine tumor (TUTER) and normal uterus (UTERU) showed that the genes whose expression levels were different between the two were 94 clones indicated in Table 14.

The result of comparative analysis of cDNA libraries derived from tongue cancer (CTONG) and normal tongue (NTONG) showed that the genes whose expression levels were different between the two were 178 clones indicated in Table 15.

These genes are involved in cancers.

Further, there is a method to search for genes involved in development and differentiation, which is the expression frequency analysis in which the expression levels of genes are compared between developing and/or differentiating tissues and/or cells and adult tissues and/or cells. The genes involved in tissue development and/or differentiation are genes participating in tissue construction and expression of function, and thus are useful genes, which are available for regenerative medicine aiming at convenient regeneration of injured tissues.

By using the information of gene expression frequency gained from the database of 5'-end nucleotide sequences described above, genes involved in development or differentiation of particular tissues were selected from the 1639 clones whose full-length nucleotide sequence had been revealed (see Example 7).

The result of comparative analysis of cDNA libraries derived from fetal brain (FCBBF, FEBRA or OCBBF) and adult brain (BRACE, BRALZ, BRAMY, BRAWH, BRCAN, BRCOC, BRHIP, BRSSN, BRSTN or BRTHA) showed that the genes whose expression levels were different between the two were 745 clones indicated in Tables 16 to 36.

The result of comparative analysis of cDNA libraries derived from fetal heart (FEHRT) and adult heart (HEART) showed that the genes whose expression levels were different between the two were 54 clones indicated in Table 37.

The result of comparative analysis of cDNA libraries derived from fetal kidney (FEKID) and adult kidney (KIDNE) showed that the genes whose expression levels were different between the two were 145 clones indicated in Table 38.

The result of comparative analysis of cDNA libraries derived from fetal lung (FELNG) and adult lung (HLUNG) showed that the genes whose expression levels were different between the two were 63 clones indicated in Table 39. These genes are involved in regeneration of tissues and/or cells.

The expression frequency or the like can be analyzed by PCR based on the nucleotide sequences of cDNAs of the present invention. There are some known methods for comparing the quantities of amplification products obtained by PCR. For example, the band intensities can be determined by ethidium bromide staining. With RI-labeled, or fluorescently labeled primers, the RI signal or fluorescence intensity can be assayed for the quantity of labeled amplification products. Alternatively, the quantity of amplification products can also be determined by measuring the RI signal or the fluorescence intensity from the RI-labeled or fluorescently labeled probe hybridizing to the products. The assay results thus obtained are compared and then the clones exhibiting differences in the expression levels can be selected.

There are some quantitative PCR methods: a PCR method using internal standards; a competitive PCR, in which the quantification is achieved by adding, to a sample, a dilution series of a known quantity of a template RNA and by comparing the quantity of an amplification product derived from the RNA of interest with the quantity of an amplification product derived from the template RNA. These methods overcome the problems of errors in the amount of amplification products among tubes and of the plateau effect. ATAC-PCR (Adaptor-tagged competitive PCR) is a method of competitive PCR which is practiced by using multiple adapters of different sizes attached to a gene whose 3'-end nucleotide sequence has previously been determined. The ratio of expression frequency of a single mRNA species from a number of tissues (cells) can be assayed in a single step (Nucleic Acids Research 1997, 25(22): 4694–4696; "DNA Micro-array and Advanced PCR Techniques", Cell Technology, supplement, Eds., Muramatsu and Nawa (Shujunsha, 2000): 104–112).

If it is observed, by using these analytical methods, that the expression levels of genes are evidently varied during major cellular events (such as differentiation and apoptosis), the genes are involved in the cellular events and accordingly are candidates for disease- and/or disorder-related genes. Further, genes exhibiting tissue-specific expression are genes playing important parts in the tissue functions and, therefore, can be candidates for genes involved in diseases and/or disorders affecting the tissues.

For example, inflammation is an important biological response that is known to be involved in various diseases. The representative inflammation-inducing factors include TNF-α (Tumor Necrosis Factor-alpha), LPS (Lipopolysaccharides), etc. Many genes have been identified as genes located downstream of the TNF-α or LPS stimulation. The respective stimulations are transduced through independent pathways of signaling cascade. There exists another signaling cascade for both stimulations, wherein NF-κB is a common transducing molecule shared by the two stimulations (Cell 1995, 80:529–532). It has also been revealed that many inflammation-related genes, including IL-2, IL-6 and G-CSF, are varied in the expression levels thereof in response to the signal through the common pathway (Trends Genet. 1999, 15 (6): 229–235). It is assumed that genes whose expression levels are varied in response to the stimulation of TNF-α or LPS also participate in inflammation.

Further, the infection of *Helicobacter pylon* to the gastric epithelia is known to cause gastritis and gastroduodenal ulcer (Mebio 2000 Jul. 17, (7): 16–33). Thus, the genes whose expression levels are altered depending on co-culturing cells with *Helicobacter pylori* may be involved in gastritis and gastroduodenal ulcer. A recent study has suggested that *Helicobacter pylori* strongly activates the NF-κB pathway, via the TRAF2/6-IKKβ pathway, namely, via the same pathway shared by TNF-α (Gastroenterology 2000, 119: 97–108).

THP-1 cell, which is a human monocyte cell line, was cultured in the presence of TNF-α (Tumor Necrosis Factor-alpha) or LPS (Lipopolysaccharides). The genes whose expression levels were altered owing to the presence of the agent were searched for, and the result showed that the clones whose expression levels were increased owing to the presence of TNF-α were
ADRGL10000180, BRACE20030780, BRACE20077640, BRACE20083850, BRAWH20004430, FCBBF10006180, FEBRA20003780, FEBRA20006800, FEBRA20012940, FEBRA20015840, HEART20004480, HLUNG10000370, HLUNG20001160, HSYRA20013320, IMR3220008380, KIDNE10001520, KIDNE20040540, KIDNE20061490, KIDNE20062990, NT2NE10001630, NT2NE20003920, NT2NE20005500, NT2RI20014500, NT2RI20016570, NT2RI20078270, NT2RI20083360, NTONG10002570, PUAEN10003220, SKNMC10000290, STOMA20002570, TESTI20011340, UTERU20004850.

On the other hand, the clones whose expression levels were decreased owing to the presence of TNF-α were BRACE20013400, BRACE20091880, HEART20005060, HLUNG200017,60, IMR3220008590, NT2NE10001850, NT2RI20018660, NT2RI20053350, NT2RI20070480, PLACE60047380, STOMA20002890, SYNOV20001770, TRACH20001960.

Further, the clones whose expression levels were increased owing to the presence of LPS were
FCBBF10006180, FEBRA20015840, HLUNG10000370, HLUNG20001160, HSYRA20013320, KIDNE20040540, KIDNE20061490, NT2NE10001630, NT2NE20003920, NT2NE20005500, NT2RI20014500, NT2RI20016570, NT2RI20078270, NTONG10002570, PUAEN10003220, STOMA20002570, TESTI20011340.

On the other hand, the clones whose expression levels were decreased owing to the presence of LPS were BRACE20013400, BRACE20091880, HEART20005060, HLUNG20001760, NT2RI20070480, UMVEN20001330.

These clones are involved in inflammation.

MKN45, which is a gastric cancer cell line, was co-cultured with *Helicobacter pylori*. The genes whose expression levels were altered owing to the presence of *Helicobacter pylori* were searched for, and the result showed that the clones whose expression levels were increased owing to the presence of *Helicobacter pylori* were BRACE10001590, BRACE20079530, BRAWH10001620, FEBRA20006800, KIDNE20003490, KIDNE20040540, KIDNE20050420, NT2NE10001850, STOMA20002890, SYNOV20001770, TESTI10000550, UTERU20004850. On the other hand, the clones whose expression levels were decreased owing to the presence of *Helicobacter pylori* were BRACE20034490, BRACE20077640, BRACE20083850, KIDNE20005170, LIVER20000330, NT2RP60000390, NTONG10000980, UMVEN20001330.

These clones are involved in gastritis or gastroduodenal ulcer.

For example, if the polypeptide encoded by the cDNA of the present invention is a regulatory factor of cellular conditions such as growth and differentiation, it can be used for developing medicines as follows. The polypeptide or antibody provided by the invention is injected into a certain kind of cells by microinjection. Then, using the cells, it is possible to screen low molecular weight compounds, etc. by measuring the change in the cellular conditions, or the activation or inhibition of a particular gene. The screening can be performed as follows.

First, the polypeptide is expressed and purified as recombinant. The purified polypeptide is microinjected into cells such as various cell lines, or primary culture cells, and the cellular change such as growth and differentiation can be examined. Alternatively, the induction of genes whose expression is known to be involved in a particular change of cellular conditions may be detected by the amount of mRNA or polypeptide. Alternatively, the amount of intracellular molecules (low molecular weight compounds, etc.) that is changed by the function of the gene product (polypeptide) which is known to be involved in a particular change of cellular conditions may be detected. The compounds to be screened (both low and high molecular compounds are acceptable) can be added to the culture media and assessed for their activity by measuring the change of the cellular conditions.

Instead of microinjection, cell lines introduced with the gene obtained in the invention can be used for the screening. If the gene product is turn out to be involved in a particular change in the cellular conditions, the change of the product can be used as a measurement for screening. Once a compound is screened out which can activate or inhibit the function of the polypeptide of the invention, it can be applied for developing medicines.

If the polypeptide encoded by the cDNA of the present invention is a secretory protein, membrane protein, or protein involved in signal transduction, glycoprotein, transcription, or diseases, it can be used in functional assays for developing medicines.

In case of a membrane protein, it is most likely to be a polypeptide that functions as a receptor or ligand on the cell surface. Therefore, it is possible to reveal a new relationship between a ligand and receptor by screening the membrane protein of the invention based on the binding activity with the known ligand or receptor. Screening can be performed according to the known methods.

For example, a ligand against the polypeptide of the invention can be screened in the following manner. Namely, a ligand that binds to a specific polypeptide can be screened by a method comprising the steps of: (a) contacting a test sample with the polypeptide of the invention or a partial peptide thereof, or cells expressing these, and (b) selecting a test sample that binds to said polypeptide, said partial peptide, or said cells.

On the other hand, for example, screening using cells expressing the polypeptide of the present invention that is a receptor protein can also be performed as follows. It is possible to screen receptors that is capable of binding to a specific polypeptide by using procedures (a) attaching the sample cells to the polypeptide of the invention or its partial peptide, and (b) selecting cells that can bind to the said polypeptide or its partial peptide.

In a following screening as an example, first the polypeptide of the invention is expressed, and the recombinant polypeptide is purified. Next, the purified polypeptide is labeled, binding assay is performed using a various cell lines or primary cultured cells, and cells that are expressing a receptor are selected (Growth and differentiation factors and their receptors, Shin-Seikagaku Jikken Kouza Vol. 7 (1991) Honjyo, Arai, Taniguchi, and Muramatsu edit, p 203–236, Tokyo-Kagaku-Doujin). A polypeptide of the invention can be labeled with RI such as $^{125}$I, and enzyme (alkaline phosphatase etc.).

Alternatively, a polypeptide of the invention may be used without labeling and then detected by using a labeled antibody against the polypeptide. The cells that are selected by the above screening methods, which express a receptor of the polypeptide of the invention, can be used for the further screening of an agonists or antagonists of the said receptor.

Once the ligand binding to the polypeptide of the invention, the receptor of the polypeptide, of the invention or the cells expressing the receptor are obtained by screening, it is possible to screen a compound that binds to the ligand and receptor. Also it is possible to screen a compound that can inhibit both bindings (agonists or antagonists of the receptor, for example) by utilizing the binding activities.

When the polypeptide of the invention is a receptor, the screening method comprises the steps of (a) contacting the polypeptide of the invention or cells expressing the polypeptide of the invention with the ligand, in the presence of a test sample, (b) detecting the binding activity between said polypeptide or cells expressing said polypeptide and the ligand, and (c) selecting a compound that reduces said binding activity when compared to the activity in the absence of the test sample. Furthermore, when the polypeptide of the invention is a ligand, the screening method comprises the steps of (a) contacting the polypeptide of the invention with its receptor or cells expressing the receptor in the presence of samples, (b) detecting the binding activity between the polypeptide and its receptor or the cells expressing the receptor, and (c) selecting a compound that can potentially reduce the binding activity compared to the activity in the absence of the sample.

Samples to screen include cell extracts, expressed products from a gene library, synthesized low molecular compound, synthesized peptide, and natural compounds, for example, but are not construed to be listed here. A compound that is isolated by the above screening using a binding activity of the polypeptide of the invention can also be used as a sample.

A compound isolated by the screening may be a candidate to be an agonist or an antagonist of the receptor of the polypeptide. By utilizing an assay that monitors a change in the intracellular signaling such as phosphorylation which results from reduction of the binding between the polypeptide and its receptor, it is possible to identify whether the obtained compound is an agonist or antagonist of the receptor. Also, the compound may be a candidate of a molecule that can inhibit the interaction between the polypeptide and its associated proteins (including a receptor) in vivo. Such compounds can be used for developing drugs for precaution or cures of a disease in which the polypeptide is involved.

Secretory proteins may regulate cellular conditions such as growth and differentiation. It is possible to find out a novel factor that regulates cellular conditions by adding the secretory protein of the invention to a certain kind of cell, and performing a screening by utilizing the cellular changes in growth or differentiation, or activation of a particular gene.

The screening can be performed, for example, as follows. First, the polypeptide of the invention is expressed and purified in a recombinant form. Then, the purified polypeptide is added to a various kind of cell lines or primary cultured cells, and the change in the cell growth and differentiation is monitored. The induction of a particular gene that is known to be involved in a certain cellular change is detected by the amounts of mRNA and polypeptide. Alternatively, the amount of an intracellular molecule (low-molecular-weight compounds, etc.) that is changed by the function of a gene product (polypeptide) that is known to function in a certain cellular change is used for the detection.

Once the screening reveals that the polypeptide of the invention can regulate cellular conditions or the functions, it is possible to apply the polypeptide as a pharmaceutical and diagnostic medicine for related diseases by itself or by altering a part of it into an appropriate composition.

As is above described for membrane proteins, the secretory protein provided by the invention may be used to explore a novel ligand-receptor interaction using a screening based on the binding activity to a known ligand or receptor. A similar method can be used to identify an agonist or antagonist. The resulting compounds obtained by the methods can be a candidate of a compound that can inhibit the interaction between the polypeptide of the invention and an interacting molecule (including a receptor). The compounds may be able to use as a preventive, therapeutic, and diagnostic medicine for the diseases, in which the polypeptide may play a certain role.

Proteins involved in signal transduction or transcription may be a factor that affects a certain polypeptide or gene in response to intracellular/extracellular stimuli. It is possible to find out a novel factor that can affect a polypeptide, or gene by expressing the polypeptide provided by the invention in a certain types of cells, and performing a screening utilizing the activation of a certain intracellular polypeptide or gene.

The screening may be performed as follows. First, a transformed cell line expressing the polypeptide is obtained. Then, the transformed cell line and the untransformed original cell line are compared for the changes in the expression of a certain gene by detecting the amount of its mRNA or polypeptide. Alternatively, the amount of an intracellular molecule (low molecular weight compounds, etc.) that is changed by the function of a certain gene product (polypeptide) may be used for the detection. Furthermore, the change of the expression of a certain gene can be detected by introducing a fusion gene that comprises a regulatory region of the gene and a marker gene (luciferase, β-galactosidase, etc.) into a cell, expressing the polypeptide provided by the invention into the cell, and estimating the activity of a marker gene product (polypeptide).

If the polypeptide or gene of the invention is involved in diseases, it is possible to screen a gene or compound that, can regulate its expression and/or activity either directly or indirectly by utilizing the polypeptide of the present invention.

For example, the polypeptide of the invention is expressed and purified as a recombinant polypeptide. Then, the polypeptide or gene that interacts with the polypeptide of the invention is purified, and screened based on the binding. Alternatively, the screening can be performed by adding with a compound of a candidate of the inhibitor added in advance and monitoring the change of binding activity. In another method, a, transcription regulatory region locating in the 5'-upstream of the gene encoding the polypeptide of the invention that is capable of regulating the expression of other genes is obtained, and fused with a marker gene. The fusion is introduced into a cell, and the cell is added with compounds to explore a regulatory factor of the expression of the said gene.

The compound obtained by the screening can be used for developing pharmaceutical and diagnostic medicines for the diseases in which the polypeptide of the present invention is involved. Similarly, if the regulatory factor obtained in the screening is turn out to be a polypeptide, compounds that can newly affect the expression or activity of the polypeptide may be used as a medicine for the diseases in which the polypeptide of the invention is involved.

If the polypeptide of the invention has an enzymatic activity, regardless as to whether it is a secretory protein, membrane protein, or proteins involved in signal transduction, glycoprotein, transcription, or diseases, a screening may be performed by adding a compound to the polypeptide of the invention and monitoring the change of the compound. The enzymatic activity may also be utilized to screen a compound that can inhibit the activity of the polypeptide.

In a screening given as an example, the polypeptide of the invention is expressed and the recombinant polypeptide is purified. Then, compounds are contacted with the purified polypeptide, and the amount of the compound and the reaction products is examined. Alternatively, compounds that are candidates of an inhibitor are pretreated, then a compound (substrate) that can react with the purified polypeptide is added, and the amount of the substrate and the reaction products is examined.

The compounds obtained in the screening may be used as a medicine for diseases in which the polypeptide of the invention is involved. Also they can be applied for tests that examine whether the polypeptide of the invention functions normally in vivo.

Whether the secretory protein, membrane protein, signal transduction-related protein, glycoprotein-related protein, or transcription-related protein of the present invention is a novel protein involved in diseases or not is determined in another method than described above, by obtaining a specific antibody against the polypeptide of the invention, and examining the relationship between the expression or activity of the polypeptide and a certain disease. In an alternative way, it may be analyzed referred to the methods in "Molecular Diagnosis of Genetic Diseases" (Elles R. edit, (1996) in the series of "Method in Molecular Biology" (Humana Press).

Proteins involved in diseases are targets of screening as mentioned, and thus are very useful in developing drugs which regulate their expression and activity. Also, the proteins are useful in the medicinal industry as a diagnostic marker of the related disease or a target of gene therapy.

Compounds isolated as mentioned above can be administered to patients as it is, or after formulated into a pharmaceutical composition according to the known methods. For example, a pharmaceutically acceptable carrier or vehicle, specifically sterilized water, saline, plant oil, emulsifier, or suspending agent can be mixed with the compounds appropriately. The pharmaceutical compositions can be administered to patients by a method known to those skilled in the art, such as intraarterial, intravenous, or subcutaneous injections. The dosage may vary depending on the weight or age of a patient, or the method of administration, but those skilled in the art can choose an appropriate dosage properly. If the compound is encoded by polynucleotide, the polynucleotide can be cloned into a vector for gene therapy, and used for gene therapy. The dosage of the polynucleotide and the method of its administration may vary depending on the weight or age of a patient, or the symptoms, but those skilled in the art can choose properly.

The present invention further relates to databases comprising at least a sequence of polynucleotide and/or polypeptide, or a medium recorded in such databases, selected from the sequence data of the nucleotide and/or the amino acids indicated in Table 1. The term "database" means a set of accumulated information as machine-searchable and readable information of nucleotide sequence. The databases of the present invention comprise at least one of the novel nucleotide sequences of polynucleotides provided by the present invention. The databases of the present invention can consist of only the sequence data of the novel polynucleotides provided by the present invention or can comprise other information on nucleotide sequences of known full-length cDNAs or ESTs. The databases of the present invention can be comprised of not only the information on the nucleotide sequences but also the information on the gene functions revealed by the present invention. Additional information such as names of DNA clones carrying the full-length cDNAs can be recorded or linked together with the sequence data in the databases.

The database of the present invention is useful for gaining complete gene sequence information from partial sequence information of a gene of interest. The database of the present invention comprises nucleotide sequence information of full-length cDNAs. Consequently, by comparing the information in this database with the nucleotide sequence of a partial gene fragment yielded by differential display method or subtraction method, the information on the full-length nucleotide sequence of interest can be gained from the sequence of the partial fragment as a starting clue.

The sequence information of the full-length cDNAs constituting the database of the present invention contains not only the information on the complete sequences but also extra information on expression frequency of the genes as well as homology of the genes to known genes and known polypeptides. Thus the extra information facilitates rapid functional analyses of partial gene fragments. Further, the information on human genes is accumulated in the database of the present invention, and therefore, the database is useful for isolating a human homologue of a gene originating from other species. The human homologue can be isolated based on the nucleotide sequence of the gene from the original species.

At present, information on a wide variety of gene fragments can be obtained by differential display method and subtraction method. In general, these gene fragments are utilized as tools for isolating the full-length sequences thereof. When the gene fragment corresponds to an already-known gene, the full-length sequence is easily obtained by comparing the partial sequence with the information in known databases. However, when there exists no information corresponding to the partial sequence of interest in the known databases, cDNA cloning should be carried out for the full-length cDNA. It is often difficult to obtain the full-length nucleotide sequence using the partial sequence information as an initial clue. If the full-length of the gene is not available, the amino acid sequence of the polypeptide encoded by the gene remains unidentified. Thus the database of the present invention can contribute to the identification of full-length cDNAs corresponding to gene fragments, which cannot be revealed by using databases of known genes.

The present invention has provided 1639 polynucleotides. As has not yet proceeded the isolation of full-length cDNA within the human, the invention has great significance. It is known that secretory proteins, membrane proteins, signal transduction-related proteins, glycoprotein-related proteins, transcription-related proteins, and so on are involved in many diseases. The genes and proteins involved in diseases are useful for developing a diagnostic marker or medicines for regulation of their expression and activity, or as a target of gene therapy.

In particular, cDNA assumed to encode secretory proteins, which were provided by this invention, are very important for the industry since the encoded proteins themselves are expected to be useful as pharmaceutical agents and many disease-related genes may be included in them. In addition, membrane proteins, signal transduction-related proteins, transcription-related proteins, disease-related proteins, and genes encoding them can be used as indicators for diseases, etc. These cDNA are also very important for the industry, which are expected to regulate the activity or expression of the encoded protein to treat diseases, etc.

Any patents, patent applications, and publications cited herein are incorporated by reference.

The invention is illustrated more specifically with reference to the following examples, but is not to be construed as being limited thereto.

EXAMPLE 1

Preparation of cDNA Library by Oligo-Capping
(1) Extraction and Purchase of mRNA Total RNAs as mRNA sources were extracted from human tissues (shown below) by the method as described in the reference (J. Sambrook, E. F. Fritsch & T. Maniatis, Molecular Cloning Second edition, Cold Spring harbor Laboratory Press, 1989). Further, by the method as described in the reference (J. Sambrook, E. F. Fritsch & T. Maniatis, Molecular Cloning Second edition, Cold Spring harbor Laboratory Press, 1989), total RNAs as mRNA sources were extracted from human culture cells and human primary culture cells (shown below) which had been cultivated by the methods described in the catalogs.

The library names and the origins are indicated below in the order of "Library name: Origin". When a library was prepared by the subtraction method, the item is followed by a description of how to prepare the subtracted library.
<Extraction of mRNA from Human Tissues>
NTONG: Normal tongue;
CTONG: Tongue cancer;
FCBBF: Fetal brain;
OCBBF: Fetal brain;
PLACE: Placenta;
SYNOV: Synovial membrane tissue (from rheumatioid arthritis).

<Extraction of mRNA from Culture Cells>
BNGH4: H4 cells (ATCC #HTB-148);
IMR32: IMR32 cells (ATCC #CCL-127);
SKNMC: SK-N-MC cells (ATCC #HTB-10);
3NB69: NB69 cells (RCB #RCB0480);
BGGI1: GI1 cells (RCB #RCB0763);
NB9N4: NB9 cells (RCB #RCB0477);
SKNSH: SK-N-SH cells (RCB #RCB0426);
NT2RM: NT2 cells (STARATAGENE #204101);
NT2RP: NT2 cells treated with retinoic acid (RA) for 5 weeks to induce the differentiation;
NT2RI: NT2 cells treated with RA for 5 weeks to induce the differentiation, followed by the treatment with the growth inhibitor for 2 weeks;
NT2NE: NT2 cells were treated with RA and the growth inhibitor for the neuronal differentiation, and the resultant neurons were concentrated and harvested (NT2 Neuron);
NTISM: NT2 cells (STARATAGENE #204101) were treated with RA for 5 weeks to induce the differentiation, and then treated with the growth inhibitor for 2 weeks; mRNA was prepared from the cells and a cDNA library was constructed from the mRNA; the cDNAs of the library whose nucleotide sequences were shared by those of mRNAs from undifferentiated NT2 cells were subtracted by using a Subtract Kit (Invitrogen #K4320-01); the subtracted library (NT2RI-NT2RM) was provided by this procedure.

RCB indicates that the cell was provided by the Cell Bank, RIKEN GENE BANK, The Institute of Physical and Chemical Research; ATCC indicates that the cell was provided by American Type Culture Collection.

<Extraction of mRNA from Primary Culture Cells>
ASTRO: Normal human astrocyte NHA5732, Takara Shuzo #CC2565;
DFNES: Normal human dermal fibroblast (neonatal skin) ; NHDF-Neo NHDF2564, Takara Shuzo #CC2509;
MESAN: Normal human mesangial cell NHMC56046-2, Takara Shuzo #CC2559;
NHNPC: Normal human neural progenitor cell NHNP5958, Takara Shuzo #CC2599;
PEBLM: Normal human peripheral blood mononuclear cell HPBMC5939, Takara Shuzo #CC2702;
HSYRA: Human synoviocyte HS-RA (from rheumatioid arthritis) Toyobo #T404K-05;
PUAEN: Normal human pulmonary artery endothelial cells, Toyobo #T302K-05;
UMVEN: Normal human umbilical vein endothelial cell HUVEC, Toyobo #T200K-05;
HCASM: Normal human coronary artery smooth muscle cell HCASMC, Toyobo #T305K-05;
HCHON: Normal human chondrocyte HC, Toyobo #T402K-05;
HHDPC: Normal human dermal papilla cell HDPC, Toyobo #THPCK-001;
CD34C: CD34+ cells (AllCells, LLC #CB14435M);
D30ST: CD34+ cells treated with the osteoclast differentiation factor (ODF) for 3 days to induce the differentiation;
D60ST: CD34+ cells treated with ODF for 6 days to induce the differentiation;
D9OST: CD34+ cells treated with ODF for 9 days to induce the differentiation.

Then, total RNAs extracted from the following human tissues were purchased and used as mRNA sources. The library names and the origins are indicated below in the order of "Library name: Origin". When a library was prepared by the subtraction method, the item is followed by a description of how to prepare the subtracted library.

<Purchase of Total RNA Containing mRNA Extracted from Human Tissues>
ADRGL: Adrenal gland, CLONTECH #64016-1;
BRACE: Brain (cerebellum), CLONTECH #64035-1;
BRAWH: Whole brain, CLONTECH #64020-1;
FEBRA: Fetal brain, CLONTECH #64019-1;
FELIV: Fetal liver, CLONTECH #64018-1;
HEART: Heart, CLONTECH #64025-1;
HLUNG: Lung, CLONTECH #64023-1;
KIDNE: Kidney, CLONTECH #64030-1;
LIVER: Liver, CLONTECH #64022-1;
MAMGL: Mammary Gland, CLONTECH #64037-1;
PANCR: Pancreas, CLONTECH #64031-1;
PROST: Prostate, CLONTECH #64038-1;
SALGL: Salivary Gland, CLONTECH #64026-1;
SKMUS: Skeletal Muscle, CLONTECH #64033-1;
SMINT: Small Intestine, CLONTECH #64039-1;
SPLEN: Spleen, CLONTECH #64034-1;
STOMA: Stomach, CLONTECH #64090-1;
TBAES: Breast (Tumor), CLONTECH #64015-1;
TCERX: Cervix (Tumor), CLONTECH #64010-1;
TCOLN: Colon (Tumor), CLONTECH #64014-1;
TESTI: Testis, CLONTECH #64027-1;
THYMU: Thymus, CLONTECH #64028-1;
TLUNG: Lung (Tumor), CLONTECH #64013-1;
TOVAR: Ovary (Tumor), CLONTECH #64011-1;
TRACH: Trachea, CLONTECH #64091-1;
TUTER: Uterus (Tumor), CLONTECH #64008-1;
UTERU: Uterus, CLONTECH #64029-1;
ADIPS: Adipose, Invitrogen #D6005-01;
BLADE: Bladder, Invitrogen #D6020-01;
BRALZ: Cerebral cortex from an Alzheimer patient (Brain, cortex, Alzheimer), Invitrogen #D6830-01;
CERVX: Cervix, Invitrogen #D6047-01;
COLON: Colon, Invitrogen #D6050-0;
NESOP: Esophagus, Invitrogen #D6060-01;
PERIC: Pericardium, Invitrogen #D6105-01;
RECTM: Rectum, Invitrogen #D6110-01;
TESOP: Esophageal (Tumor), Invitrogen #D6860-01;
TKIDN: Kidney (Tumor), Invitrogen #D6870-01;
TLIVE: Liver (Tumor), Invitrogen #D6880-01;
TSTOM: Stomach (Tumor), Invitrogen #D6920-01;
BEAST: Adult breast, STARATAGENE #735044;
FEHRT: Fetal heart, STARATAGENE #738012;
FEKID: Fetal kidney, STARATAGENE #738014;
FELNG: Fetal lung, STARATAGENE #738020;
NOVAR: Adult ovary, STARATAGENE #735260;
BRASW: subtracted library (BRALZ-BRAWH).

A cDNA library was constructed from mRNA prepared from tissues of cerebral cortex obtained from an Alzheimer patient [BRALZ: Cerebral cortex from an Alzheimer patient (Brain, cortex, Alzheimer), Invitrogen #D6830-01]; the cDNAs of this library whose nucleotide sequences were shared by those of mRNAs from whole brain tissue [BRAWH: Whole brain, CLONTECH #64020-1] were subtracted by using a Subtract Kit (Invitrogen #K4320-01).

Further, mRNAs extracted and purified as poly A(+) RNAs from the human tissues shown below were purchased. A cDNA library was prepared from an RNA mixture in which the poly A(+) RNA from each tissue had been combined with poly A(−) RNA. The poly A(−) RNA was prepared by removing poly A(+) RNA from the total RNA of whole brain tissue (CLONTECH #64020-1) by using oligo dT cellulose. The library names and the origins are indicated below in the order of "Library name: Origin".

<Purchase of mRNAs of Human Tissues as Poly A(+) RNAs>
BRAMY: Brain (amygdala), CLONTECH #6574-1;
BRCAN: Brain (caudate nucleus), CLONTECH #6575-1;
BRCOC: Brain (corpus callosum), CLONTECH #6577-1;
BRHIP: Brain (hippocampus), CLONTECH #6578-1;
BRSSN: Brain (substantia nigra), CLONTECH #6580-1;
BRSTN: Brain (subthalamic nucleus), CLONTECH #6581-1;
BRTHA: Brain (thalamus), CLONTECH #6582-1.

(2) Preparation of cDNA Library cDNA library was prepared from each RNA by the improved method (WO 01/04286) of oligo capping [M. Maruyama and S. Sugano, Gene, 138: 171–174 (1994)]. A series of procedures, BAP (Bacterial Alkaline Phosphatase) treatment, TAP (Tobacco Acid Pyrophosphatase) treatment, RNA ligation, first strand cDNA synthesis and RNA removal, were carried out using the oligo-cap linker (SEQ ID NO: 3279) and oligo dT primer (SEQ ID NO: 3280) as described in WO 01/04286. Then, the single-stranded cDNA was converted to a double-stranded cDNA by PCR (polymerase chain reaction) using 5' (SEQ ID NO: 3281) and 3' (SEQ ID NO: 3282) PCR primers, and then digested with SfiI. Then, a fraction of cDNA fragments, typically 2-kb or longer (3-kb or longer in some cases), was unidirectionally cloned into a DraIII-digested pME18SFL3 vector (FIG. 1) (GenBank AB009864, Expression vector); the cDNA library was thus prepared.

The names of cDNA libraries, which were used in the analysis of full-length cDNA sequences, and their origins are shown in Table 2.

TABLE 2

| Library | Type | Origin, etc. |
| --- | --- | --- |
| 3NB69 | Culture cell | NB69 cells (RCB #RCB0480) |
| ADRGL | Tissue | Adrenal gland (CLONTECH #64016-1) |
| ASTRO | Primary culture cell | Normal Human Astrocyte NHA5732 (Takara Shuzo #CC2565) |
| BGGI1 | Culture cell | GI1 cells (RCB #RCB0763) |
| BNGH4 | Culture cell | H4 cells (ATCC #HTB-148) |
| BRACE | Tissue | Brain, cerebellum (CLONTECH #64035-1) |
| BRAWH | Tissue | Brain, whole (CLONTECH #64020-1) |
| CD34C | Primary culture cell | CD34+ cells (AllCells, LLC #CB14435M) |
| CTONG | Tissue | Tongue, Cancer |
| D3OST | Primary culture cell | CD34+ cells (ODF induction for 3 days) |
| DFNES | Primary culture cell | Normal Human Dermal Fibroblasts (Neonatal Skin); NHDF-Neo NHDF2564 (Takara Shuzo #CC2509) |
| FCBBF | Tissue | Brain, Fetal |
| FEBRA | Tissue | Brain, Fetal (CLONTECH #64019-1) |
| HCASM | Primary culture cell | Human coronary artery smooth muscle cells HCASMC (Toyobo #T305K-05) |
| HEART | Tissue | Heart (CLONTECH #64025-1) |
| HHDPC | Primary culture cell | Human dermal papilla cells HDPC (Toyobo #THPCK-001) |
| HLUNG | Tissue | Lung (CLONTECH #64023-1) |
| HSYRA | Primary culture cell | Human synoviocytes from rheumatioid arthritis HS-RA(Toyobo #T404K-05) |
| IMR32 | Culture cell | IMR32 cells (ATCC #CCL-127) |
| KIDNE | Tissue | Kidney (CLONTECH #64030-1) |
| LIVER | Tissue | Liver (CLONTECH #64022-1) |
| MAMGL | Tissue | Mammary Gland (CLONTECH #64037-1) |
| MESAN | Primary culture cell | Normal human mesangial cells NHMC56046-2 (Takara Shuzo #CC2559) |
| NB9N4 | Culture cell | NB9 cells (RCB #RCB0477) |
| NESOP | Tissue | Esophagus (Invitrogen #D6060-01) |
| NHNPC | Primary culture cell | Normal human neural progenitor cells NHNP5958 (Takara Shuzo #CC2599) |
| NT2NE | Culture cell | NT2 cells concentrated after differentiation (NT2 Neuron) |
| NT2RI | Culture cell | NT2 cells treated by growth inhibitor for 2 weeks after RA induction for 5 weeks |
| NT2RP | Culture cell | NT2 cells treated by RA for 5 weeks |
| NTONG | Tissue | Tongue |
| OCBBF | Tissue | Brain, Fetal |
| PANCR | Tissue | Pancreas (CLONTECH #64031-1) |
| PEBLM | Primary culture cell | Human peripheral blood mononuclear cells HPBMC5939 (Takara Shuzo #CC2702) |
| PLACE | Tissue | Placenta |
| PROST | Tissue | Prostate (CLONTECH #64038-1) |
| PUAEN | Primary culture cell | Human pulmonary artery endothelial cells (Toyobo #T302K-05) |
| SALGL | Tissue | Salivary Gland (CLONTECH #64026-1) |
| SKMUS | Tissue | Skeletal Muscle (CLONTECH #64033-1) |
| SKNMC | Culture cell | SK-N-MC cells (ATCC #HTB-10) |
| SKNSH | Culture cell | SK-N-SH cells (RCB #RCB0426) |
| SMINT | Tissue | Small Intestine (CLONTECH #64039-1) |
| SPLEN | Tissue | Spleen (CLONTECH #64034-1) |
| STOMA | Tissue | Stomach (CLONTECH #64090-1) |
| SYNOV | Tissue | Synovial membrane tissue from rheumatioid arthritis |

TABLE 2-continued

| Library | Type | Origin, etc. |
|---|---|---|
| TESTI | Tissue | Testis (CLONTECH #64027-1) |
| THYMU | Tissue | Thymus (CLONTECH #64028-1) |
| TRACH | Tissue | Trachea (CLONTECH #64091-1) |
| UMVEN | Primary culture cell | Human umbilical vein endothelial cells HUVEC (Toyobo #T200K-05) |
| UTERU | Tissue | Uterus (CLONTECH #64029-1) |

The cDNA library with the high fullness ratio (the fullness ratio of 5'-end, which was calculated for each cDNA library by using the protein coding region found in known mRNA species as an index, was 90% in average) prepared by the improved oligo-capping method was constructed by using a eukaryotic expression vector pME18SFL3. The vector contains SRα promoter and SV40 small t intron in the upstream of the cloning site, and SV40 polyA added signal sequence site in the downstream. As the cloning site of pME18SFL3 has asymmetrical DraIII sites, and the ends of cDNA fragments contain SfiI sites complementary to the DraIII sites, the cloned cDNA fragments can be inserted into the downstream of the SRα promoter unidirectionally. Therefore, clones containing full-length cDNA can be expressed transiently by introducing the obtained plasmid directly into COS cells, etc. Thus, the clones can be analyzed very easily in terms of the proteins that are the gene products of the clones, or in terms of the biological activities of the proteins.

(3) Assessment of the 5'-end Completeness of Clones Derived from the cDNA Library Prepared by Oligo-Capping With respect to the plasmid DNAs of clones derived from the libraries, the nucleotide sequences of cDNA 5'-ends (3'-ends as well in some cases) were determined in a DNA sequencer (ABI PRISM 3700, PE Biosystems), after sequencing reaction was conducted by using a DNA sequencing reagent (BigDye Terminator Cycle Sequencing FS Ready Reaction Kit, PE Biosystems) according to the manual. A database was constructed based on the obtained data.

The 5'-end completeness of about 770,000 clones derived from the human cDNA libraries prepared by the improved oligo-capping method was determined by the following method. The clones whose 5'-end sequences were consistent with those of known human mRNA in the public database were judged to be "full-length" if they had a longer 5'-end sequence than that of the known human mRNA; or-even though the 5'-end sequence was shorter, if it contained the translation initiation codon it was judged to have the "full-length" sequence. Clones which did not contain the translation initiation codon were judged to be "not-full-length". The fullness ratio ((the number of full-length clones)/(the number of full-length and not-full-length clones)) at the 5'-end of the cDNA clones was determined by comparing with known human mRNA. As a result, the fullness ratio of the 5'-ends was 90%. The result indicates that the fullness ratio at the 5'-end sequence was extremely high in the human cDNA clones obtained by the oligo-capping method.

EXAMPLE 2

Sequencing Analysis of cDNA Ends and Selection of Full-Length Clones

With respect to the plasmid DNAs of clones obtained from each cDNA library, the 5'-end nucleotide sequences of the cDNAs were determined in a DNA sequencer (ABI PRISM 3700, PE Biosystems), after sequencing reaction was conducted by using a DNA sequencing reagent (Dye Terminator Cycle Sequencing FS Ready Reaction Kit, dRhodamine Terminator Cycle Sequencing FS Ready Reaction Kit or BigDye Terminator Cycle Sequencing FS Ready Reaction Kit, PE Biosystems) according to the manual. A database was constructed using the data obtained.

For the analyzed 5'-end sequences of cDNA clones, the data with the annotation of "complete cds" in the GenBank and UniGene were searched by BLAST homology search. When identical to certain human mRNA sequences, such cDNA clones were excluded. Then, clustering was carried out. When the identity was 90% or higher, and the length of consensus sequence was 50 base pairs or longer, the cDNA clones were assumed to belong to an identical cluster, and thus clustered. cDNA clones longer in the 5' direction were selected from the members belonging to a cluster; if required, the 3'-end sequences of the selected clones were determined by the same analysis method as used to determine the 5'-end sequences. The data of the end sequences obtained were analyzed, and, then the clones forming a sequence contig at 5'- and 3'-ends were excluded. Further, as mentioned above, the data was analyzed again by BLAST homology search; when identical to certain human mRNA sequences (including sequences patented and applied for), the cDNA clones were excluded. Thus, the cDNAs clones to be analyzed for their nucleotide sequence were obtained.

EXAMPLE 3

Analysis of the Full-Length Nucleotide Sequences

The full-length nucleotide sequences of the selected clones were determined. The nucleotide sequence determination was mainly performed by primer walking method comprising the dideoxy terminator method using custom-made synthetic DNA primers. Namely, the nucleotide sequences of the DNAs were determined in a sequencer from PE Biosystems, after sequencing reaction was carried out with a DNA sequencing reagent from the same supplier using the custom-made synthetic DNA primers according to the manual. A part of the clones were analyzed with a DNA sequencer from Licor.

Further, the nucleotide sequences of a part of the clones were determined by the shotgun method where the plasmids containing the cDNAs were digested at random were used, instead of the use of custom-made primers, by the same method in the DNA sequencer. The full-length nucleotide sequences were finally determined by completely assembling the partial nucleotide sequences obtained by the above method.

Then, the regions translatable to proteins were deduced from the determined full-length nucleotide sequences, and thereby the amino acid sequences were determined. SEQ ID NOs corresponding to the respective sequences are shown in Table 1.

EXAMPLE 4

Functional Prediction by Homology Search

For the determined nucleotide sequences, GenBank, SwissProt, UniGene, and nr were searched by BLAST. The clones exhibiting higher homology, which were convenient to predict their functions based on the nucleotide sequences and deduced amino acid sequences, were selected based on the BLAST search hit data whose P value or E value was $10^{-4}$ or lower and for which the length of consensus sequence×homology=30 or higher in the amino acid database search. Further, from them, representative clones were selected, which are shown as Homology Search Result Data in the last part herein. Accordingly, the data shown herein are merely the representative data, and the molecule exhibiting homology to each clone is not limited thereto. Further, with respect to a part of clones, the BLAST search hit data that did not meet the criteria as described above are not shown herein.

EXAMPLE 5

Search for Signal Sequence, Transmembrane Domain and other Functional Domains in the Deduced Amino Acid Sequences With respect to the amino acid sequences deduced from the full-length nucleotide sequences, the prediction was made for the presence of signal sequence at the amino terminus, the presence of transmembrane domain, and the presence of functional protein domains (motifs). The signal sequence at the amino terminus was searched for by PSORT [K. Nakai & M. Kanehisa, Genomics, 14: 897–911(1992)]; the transmembrane domain, by SOSUI [T. Hirokawa et al., Bioinformatics, 14: 378–379 (1998) (Mitsui Knowledge Industry); the function domain, by Pfam. The amino acid sequence in which the signal sequence at the amino terminus or transmembrane domain had been predicted to be present by PSORT or SOSUI were assumed to be a secretory or membrane protein. Further, when the amino acid sequence hit a certain functional domain by the Pfam functional domain search, the protein function can be predicted based on the hit data, for example, by referring to the function categories on the PROSITE. In addition, the functional domain search can also be carried out on the PROSITE.

The search results obtained with the respective programs are shown below.

The clones whose deduced amino acid sequences were detected to have the signal sequences by PSORT are as follows.
ADRGL10001600, BGGI120010970, BNGH410001180, BNGH410001370, BRACE10001690, BRACE20010650, BRACE20014920, BRACE20079530, BRACE20086550, BRACE20089600, BRAWH20004430, BRAWH20040950, BRAWH20052250, BRAWH20092610, CD34C20000510, CTONG20028160, FEBRA20003780, FEBRA20004150, FEBRA20006900, FEBRA20008090, FEBRA20012270, FEBRA20015840, FEBRA20020860, FEBRA20021910, FEBRA20037070, HHDPC20000950, HLUNG10000240, HLUNG20001250, HSYRA20003470, HSYRA20014200, IMR3210001580, IMR3220007750, IMR3220008590, KIDNE10001430, KIDNE20001670, KIDNE20003300, KIDNE20042620, KIDNE20054000, KIDNE20060530, KIDNE20066520, LIVER10005420, MAMGL10000320, NHNPC20002060, NT2NE10001630, NT2NE20016260, NT2NE20055170, NT2RI20009740, NT2RI20015400, NT2RI20030110, NT2RI20042840, NT2RI20053350, NT2RI20070840, NT2RI20073030, NT2RI20074980, NT2RI20078270, NT2RI20092890, NT2RP70015910, NT2RP70021510, NT2RP70029820, NT2RP70047900, NT2RP70074220, NT2RP70079250, NT2RP70091680, NT2RP70094290, NT2RP70094980, NT2RP70095070, NTONG10000980, NTONG10002140, NTONG10002570, OCBBF10000420, PANCR10000210, PLACE60020840, PLACE60026990, PLACE60043960, PLACE60049930, PLACE60050290, PROST10005260, PROST10005360, PROST20000360, PROST20029600, PROST20044160, PROST20054260, PROST20058800, SMINT10000160, SPLEN10000910, SPLEN20001340, STOMA20002570, TESTI20026320, TESTI20026980, TESTI20027070, TESTI20028660, TESTI20042870, TESTI20049940, THYMU10000830, UTERU10001920, UTERU20003930, UTERU20004850

The clones whose deduced amino acid sequences were detected to have the transmembrane domains by SOSUI are as follows. Numerals indicate the numbers of transmembrane domains detected in the deduced amino acid sequences. Of the search result, the clone name and the number of transmembrane domains are demarcated by a double slash-mark (//)

3NB6910000180//4, 3NB6910000850//1,
3NB6920000290//2, 3NB6920003300//5,
3NB6920005450//2, ADRGL10000180//1,
ADRGL10001600//1, ADRGL20003230//2,
BGGI120010970//1, BNGH410000800//2,
BNGH410001040//2, BNGH410001370//1,
BNGH410001980//11, BRACE20007180//1,
BRACE20010650//1, BRACE20011170//2,
BRACE20013400//2, BRACE20013520//2,
BRACE20014230//2, BRACE20014530//1,
BRACE20014920//1, BRACE20018590//1,
BRACE20022270//1, BRACE20026850//1,
BRACE20030780//3, BRACE20031100//10,
BRACE20034490//2, BRACE20071380//3,
BRACE20071970//1, BRACE20072810//2,
BRACE20075020//1, BRACE20075380//3,
BRACE20076410//1, BRACE20076850//1,
BRACE20077610//2, BRACE20077640//2,
BRACE20077980//1, BRACE20086550//1,
BRACE20089600//1, BRACE20091880//1,
BRAWH10000010//1, BRAWH10000370//1,
BRAWH10000940//1, BRAWH10001620//1,
BRAWH10001800//1, BRAWH20004430//8,
BRAWH20006970//1, BRAWH20011290//4,
BRAWH20014380//2, BRAWH20015030//2,
BRAWH20036930//1, BRAWH20038320//2,
BRAWH20059980//1, BRAWH20087060//1,
BRAWH20092610//3, CD34C20000510//1,
CTONG20015330//1, CTONG20028160//2,
CTONG20037820//1, CTONG20047160//4,
FCBBF10006180//3, FCBBF10006750//2,
FCBBF20005910//1, FCBBF20009400//3,
FCBBF20015380//5, FEBRA20004040//2,
FEBRA20004150//3, FEBRA20004520//3,
FEBRA20004910//2, FEBRA20006560//3,
FEBRA20008800//1, FEBRA20010930//7,
FEBRA20012450//3, FEBRA20012940//1,
FEBRA20013510//2, FEBRA20014870//1,
FEBRA20015840//2, FEBRA20020860//2,
FEBRA20021910//1, FEBRA20031550//2,
FEBRA20041910//1, FEBRA20063150//1,
FEBRA20066670//2, HCASM10000610//2,
HCASM20002020//1, HEART20000990//1,
HEART20004920//2, HHDPC20000950//2,
HLUNG10000370//2, HLUNG20001160//1,
HLUNG20001420//12, HLUNG20001760//2,
HSYRA20003470//1, HSYRA20008280//1,
HSYRA20011030//1, HSYRA20015800//1,
IMR3210000440//1, IMR3210001580//2,
IMR3210002660//6, IMR3220008590//1,

IMR3220009840//2, KIDNE10001040//1, PROST20000360//1, PROST20001760//4,
KIDNE10001430//1, KIDNE20000700//1, PROST20029600//2, PROST20033020//1,
KIDNE20000850//1, KIDNE20001670//7, PROST20039220//3, PROST20044160//1,
KIDNE20003150//1, KIDNE20003300//1, PROST20051430//1, PROST20054260//5,
KIDNE20003490//4, KIDNE20004220//1, PROST20059190//3, PROST20059430//3,
KIDNE20005170//7, KIDNE20033050//2, PROST20069880//1, PROST20072370//1,
KIDNE20033570//1, KIDNE20039410//5, PUAEN10000570//1, PUAEN10001610//1,
KIDNE20044110//3, KIDNE20048280//12, PUAEN10003220//1, SKMUS20007740//1,
KIDNE20049810//2, KIDNE20054770//12, SKNMC10000190//1, SKNMC10000290//1,
KIDNE20060530//2, KIDNE20060620//2, SKNMC10002290//2, SKNMC10002510//8,
KIDNE20063530//1, KIDNE20066520//2, SMINT10000160//2, SMINT10000420//8,
KIDNE20067600//1, KIDNE20071860//1, SMINT10000570//2, SMINT10001180//1,
KIDNE20074220//1, KIDNE20075690//5, SMINT20000180//2, SMINT20002770//3,
LIVER10000580//3, LIVER10000670//1, SPLEN20001340//1, SPLEN20002430//1,
LIVER10001040//2, LIVER10001110//1, SPLEN20002700//1, SPLEN20003100//1,
LIVER10001750//1, LIVER20004160//1, SPLEN20004960//2, STOMA10000520//2,
MAMGL10001780//1, MAMGL10001840//2, STOMA10001170//1, STOMA20000320//1,
MESAN10001470//1, MESAN10001800//7, STOMA20002570//3, SYNOV20001770//2,
MESAN20001490//2, NB9N420000420//1, TESTI10000420//1, TESTI10000960//1, TESTI20006000//
NHNPC20002060//2, NT2NE10000230//1, 1, TESTI20009090//1, TESTI20009700//7,
NT2NE10001850//6, NT2NE20003920//1, TESTI20011340//5, TESTI20012370//1, TESTI20013520//
NT2NE20004550//1, NT2NE20004700//1, 4, TESTI20014200//9, TESTI20016210//2,
NT2NE20005570//1, NT2NE20012470//2, TESTI20016710//1, TESTI20018620//2, TESTI20020020//
NT2NE20014350//1, NT2NE20016260//4, 2, TESTI20020810//8, TESTI20022510//3,
NT2NE20034080//2, NT2NE20047160//1, TESTI20024670//2, TESTI20025800//2, TESTI20026980//
NT2NE20055170//3, NT2NE20057200//1, 2, TESTI20027000//1, TESTI20030370//1,
NT2RI20005970//7, NT2RI20014490//11, TESTI20031930//1, TESTI20042870//3, TESTI20047120//
NT2RI20016570//2, NT2RI20018460//1, 5, TESTI20049940//2, TESTI20057420//1,
NT2RI20018660//2, NT2RI20021520//7, TESTI20058600//6, TESTI20067740//2, TESTI20069780//
NT2RI20022430//4, NT2RI20022520//3, 3, TESTI20074800//5, TESTI20077490//4,
NT2RI20030110//1, NT2RI20030510//2, TESTI20079510//3, TESTI20080200//7, TESTI20081440//
NT2RI20033830//2, NT2RI20036780//1, 1, TESTI20087740//2, TESTI20088470//2,
NT2RI20044420//1, NT2RI20049850//2, TESTI20136910//1, THYMU10001760//1,
NT2RI20050870//8, NT2RI20051500//1, THYMU10003290//1, THYMU10003820//4,
NT2RI20066820//1, NT2RI20068250//11, THYMU10005580//4, TRACH10000630//3,
NT2RI20070480//1, NT2RI20077540//4, TRACH10001000//1, TRACH10001400//1,
NT2RI20078790//1, NT2RI20081880//3, TRACH20001850//2, TRACH20001960//2,
NT2RI20085980//3, NT2RI20092890//2, TRACH20004960//2, TRACH20006650//11,
NT2RI20094060//4, NT2RP60000320//10, TRACH20007670//2, TRACH20008980//2,
NT2RP60000390//1, NT2RP60001090//1, TRACH20015920//2, UMVEN20001330//2,
NT2RP70002380//4, NT2RP70002590//5, UTERU10000770//2

The Names of clones whose deduced amino acid sequences were detected to have functional domains with Pfam, and the name of hit functional domains are as follows. The search result is indicated as "clone name//functional domain name". When the clone has multiple hit functional domains, they are listed and demarcated by a double slash mark (//). When the clone has multiple hits of an identical functional domain, each is listed without abridgment.

3NB6910000180//TS-N domain//UBA domain
3NB6910001160//START domain
3NB6910001290//KRAB box
3NB6910001730//RI01/ZK632.3/MJ0444 family
3NB6920002810//DEAD/DEAH box helicase//Helicases conserved C-terminal domain
3NB6920009120//Zinc finger, C2H2 type//Zinc finger, C2H2 type//Zinc finger, C2H2 type//Zinc finger, C2H2 type//Frataxin-like domain
3NB6920010020//Regulator of G protein signaling domain
3NB6920014330//Domain of unknown function
3NB6920014710//DNA binding domain with preference for A/T rich regions//Zinc finger, C2H2 type
3NB6920015110//RNA recognition motif. (a.k.a. RRM, RBD, or RNP domain)//RNA recognition motif. (a.k.a. RRM, RBD, or RNP domain)
3NB6920015570//KRAB box//Zinc finger, C2H2 type//Zinc finger, C2H2 type//Zinc finger, C2H2 type//Zinc finger, (continuing list:)
NT2RP70003640//1, NT2RP70004770//4,
NT2RP70006240//1, NT2RP70011660//11,
NT2RP70015910//2, NT2RP70021510//1,
NT2RP70023790//2, NT2RP70026190//1,
NT2RP70043730//3, NT2RP70047900//2,
NT2RP70049250//1, NT2RP70064080//3,
NT2RP70071540//2, NT2RP70071770//13,
NT2RP70072520//2, NT2RP70073810//3,
NT2RP70075040//4, NT2RP70076170//2,
NT2RP70079750//2, NT2RP70081330//2,
NT2RP70081370//8, NT2RP70085500//2,
NT2RP70090120//10, NT2RP70091490//3,
NT2RP70093220//11, NT2RP70093730//1,
NT2RP70094290//1, NT2RP70094810//12,
NT2RP70094980//3, NTONG10002570//2,
NTONG20002650//4, NTONG20004920//1,
NTONG20008000//1, NTONG20012220//1,
OCBBF20002310//2, OCBBF20009980//1,
OCBBF20012100//2, PLACE50000670//1,
PLACE50001050//1, PLACE60005550//2,
PLACE60012810//2, PLACE60018860//7,
PLACE60020160//1, PLACE60020840//6,
PLACE60037050//1, PLACE60037450//1,
PLACE60047380//1, PLACE60049930//1,
PLACE60050290//1, PROST10002200//2,
PROST10002720//1, PROST10005360//1, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type ADRGL10000020//BTB/POZ domain//Kelch motif//Kelch motif ADRGL10000650//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type ADRGL10001600//Cytochrome P450//Cytochrome P450

ADRGL10001650//Urease//Chlorohydrolase//Dihydroorotase-like

ADRGL20000740//Dockerin domain type I//RhoGAP domain

ASTRO10000180//WD domain, G-beta repeat//WD domain, G-beta repeat//WD domain, G-beta repeat//WD domain, G-beta repeat ASTRO20000950//SNAP-25 family ASTRO20004170//Ribonuclease T2 family BGGI120005330//IMP dehydrogenase/GMP reductase N terminus//CBS domain//CBS domain//Dihydroorotate dehydrogenase//Histidine biosynthesis protein//FMN-dependent dehydrogenase//Conserved region in glutamate synthase//IMP dehydrogenase /GMP reductase C terminus BGGI120005440//Importin beta binding domain BGGI120006840//Sir2 family BGGI120006930//Collagen triple helix repeat (20 copies)//SAM domain (Sterile alpha motif)

BGGI120010970//F5/8 type C domain//Laminin G domain//Laminin G domain//Fibrinogen beta and gamma chains, C-terminal globular domain BGGI120017140//KRAB box//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type BNGH410000290//SPRY domain BNGH410000340//Prolyl oligopeptidase family//Phospholipase/Carboxylesterase BNGH410001040//Eukaryotic protein kinase domain BNGH410001180//Low-density lipoprotein receptor domain class A//Low-density lipoprotein receptor domain class A//Low-density lipoprotein receptor domain class A//WAP-type (Whey Acidic Protein) four-disulfide core//Low-density lipoprotein receptor domain class A//Low-density lipoprotein receptor domain class A//Low-density lipoprotein receptor domain class A//Low-density lipoprotein receptor domain class A//long chain scorpion toxins//Chitin binding Peritrophin-A domain//Low-density lipoprotein receptor repeat class B//Low-density lipoprotein receptor repeat class B//Low-density lipoprotein receptor repeat class B//Low-density lipoprotein receptor repeat class B//Low-density lipoprotein receptor repeat class B BNGH410001370//Filamin/ABP280 repeat.

BNGH410001770//IMP dehydrogenase /GMP reductase N terminus//CBS domain//CBS domain//Dihydroorotate dehydrogenase//Histidine biosynthesis protein//FMN-dependent dehydrogenase//Conserved region in glutamate synthase//IMP dehydrogenase/GMP reductase C terminus BNGH410001900//Viral (Superfamily 1) RNA helicase BNGH410001980//POT family//Bacteriorhodopsin//Sugar (and other) transporter BNGH420005320//SCAN domain//KRAB box//Zinc finger, C2H2 type//GATA zinc finger//Zinc finger, C2H2 type//Zinc finger, C2H2 type//Zinc finger, C2H2 type//Zinc finger, C2H2 type//Transcription factor S-II (TFIIS)//Zinc finger, C2H2 type BRACE10000420//Fatty acid desaturase//Protein phosphatase 2C BRACE10000930//Zinc finger, C3HC4 type (RING finger)//TRAF-type zinc finger//TRAF-type zinc finger//MATH domain BRACE10001150//DNA gyrase/topoisomerase IV, subunit A//Nucleosome assembly protein (NAP)

BRACE10001660//Zinc finger, C2H2 type

BRACE20002800//IQ calmodulin-binding motif

BRACE20005650//ATP synthase ab C terminal

BRACE20006980//Ank repeat//Ank repeat//Ank repeat//Ank repeat//Ank repeat//Ank repeat BRACE20007180//Calcitonin/CGRP/IAPP family BRACE20008850//Zinc finger, C3HC4 type (RING finger)

BRACE20010650//F-box domain.

BRACE20013750//Hepatitis C virus non-structural protein NS4a

BRACE20014920//Protein-tyrosine phosphatase

BRACE20018550//Ank repeat//Ank repeat//Ank repeat//Ank repeat//Ank repeat

BRACE20018590//Transmembrane 4 family

BRACE20019440//Protein of unknown function DUF82

BRACE20020910//Zinc finger, C3HC4 type (RING finger)//Zinc finger, C3HC4 type (RING finger)//E7 protein, Early protein//B-box zinc finger.

BRACE20022020//Eukaryotic protein kinase domain

BRACE20024090//Homeobox domain

BRACE20024680//Similarity to lectin domain of ricin beta-chain, 3 copies.

BRACE20026850//short chain dehydrogenase

BRACE20027720//Metallo-beta-lactamase superfamily

BRACE20027920//FGGY family of carbohydrate kinases

BRACE20028120//Ras family//ADP-ribosylation factor family

BRACE20031100//Domain of unknown function DUF20//Patched family

BRACE20071740//KRAB box//Zinc finger, C2H2 type//Transcription, factor S-II, (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type BRACE20074010//EF hand//EF hand//Mitochondrial carrier proteins//Mitochondrial carrier proteins//Mitochondrial carrier proteins BRACE20074470//Cadherin domain//Cadherin domain//Glutathione peroxidases//Cadherin domain BRACE20076410//Sushi domain (SCR repeat)//Sushi domain (SCR repeat)//Sushi domain (SCR repeat)

BRACE20076630//PH domain

BRACE20080970//Phosphofructokinase

BRACE20083800//Fibronectin type III domain

BRACE20083850//bZIP transcription factor//Homeobox associated leucine zipper

BRACE20084430//Thioredoxin//Thioredoxin

BRACE20092120//3'–5' exonuclease//Adenylylsulfate kinase//Protein of unknown function DUF82

BRACE20093610//Bacterial type II secretion system protein

BRAWH10000940//Rieske [2Fe-2S] domain//Phosphoglucose isomerase//FAD binding domain//Pyridine nucleotide-disulphide oxidoreductase//Phytoene dehydrogenase related enzyme BRAWH10001300//PH domain//RhoGAP domain//Tropomyosins
BRAWH10001620//alpha/beta hydrolase fold
BRAWH10001640//KRAB box//ENV polyprotein (coat polyprotein)
BRAWH10001680//Homeobox domain
BRAWH20000480//Transposase//Kinesin motor domain
BRAWH20001770//Serine hydroxymethyltransferase
BRAWH20003230//Wiskott Aldrich syndrome homology region 2
BRAWH20004430//Lectin (probable mannose binding)//Surfactant associated polypeptide
BRAWH20004760//Zinc finger, C2H2 type//Zinc finger, C2H2 type
BRAWH20006330//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
BRAWH20006510//HMGL-like
BRAWH20006860//Eukaryotic protein kinase domain//Protein kinase C terminal domain
BRAWH20009840//Cytochrome P450
BRAWH20011660//Glycosyl hydrolases family 35
BRAWH20012030//Phorbol esters/diacylglycerol binding domain (C1 domain)//Zinc finger, C3HC4 type (RING finger)//PHD-finger
BRAWH20014180//Adenosine-deaminase (editase) domain
BRAWH20014610//TS-N domain//UBA domain
BRAWH20014840//Glycosyl transferases//Similarity to lectin domain of ricin beta-chain, 3 copies.
BRAWH20036890//Protein phosphatase 2C
BRAWH20059980//CUB domain//Low-density lipoprotein receptor domain class A//CUB domain//Low-density lipoprotein receptor domain class A//Fz domain
BRAWH20060440//PPR repeat
BRAWH20064500//Nuclear transition protein 2//HMG (high mobility group) box
BRAWH20076050//Keratin, high sulfur B2 protein
BRAWH20089560//Poly-adenylate binding protein, unique domain.//Magnesium chelatase, subunit ChlI//Uncharacterized protein family UPF0034//KE2 family protein//Formin Homology 2 Domain
BRAWH20093600//Family 4 glycosyl hydrolase
CD34C20000510//Glycosyl hydrolases family 18//Glycosyl hydrolases family 18//Chitin binding Peritrophin-A domain
CTONG20005890//DNA gyrase/topoisomerase IV, subunit A//PDZ domain (Also known as DHR or GLGF).//PDZ domain (Also known as DHR or GLGF).
CTONG20011390//Prokaryotic dksA/traR C4-type zinc finger//Hepatitis C virus non-structural protein NS2
CTONG20013200//Uncharacterized protein family UPF0020
CTONG20018200//PHD-finger//PHD-finger//PWWP domain//SET domain
CTONG20019550//Spectrin repeat//Xylose isomerase//Spectrin repeat//Spectrin repeat//Spectrin repeat//Flagellar hook-associated protein 2//Adhesin lipoprotein//Spectrin repeat//Spectrin repeat//Protein of unknown function DUF118//Spectrin repeat//Bacterial flagellin N-terminus//Spectrin repeat//Spectrin repeat//Spectrin repeat//Caulimovirus movement protein//Spectrin repeat
CTONG20025580//Zinc finger, C2H2 type//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type
CTONG20028030//Domain of unknown function DUF19//Ribosomal protein S18
CTONG20028160//Cadherin domain//Cadherin domain//Cadherin domain//Cadherin domain//Cadherin cytoplasmic region
CTONG20028200//Papain family cysteine protease//E2 (early) protein, N terminal//T-box
CTONG20037820//Neurotransmitter-gated ion-channel//Neurotransmitter-gated ion-channel
CTONG20047160//PCI domain//Latrophilin/CL-1-like GPS domain
CTONG20055530//Ank repeat//Ank repeat//Ank repeat//Ank repeat//Ank repeat//Ank repeat//Pyridoxal-dependent decarboxylase conserved domain//Ank repeat//Ank repeat//Ank repeat//Ank repeat//Ank repeat//Ank repeat//Ank repeat//Ank repeat//Ank repeat
CTONG20064490//PCI domain
D30ST20001840//RNA recognition motif. (a.k.a. RRM, RBD, or RNP domain)
DFNES20002120//Queuine tRNA-ribosyltransferase
DFNES20002680//Protozoan/cyanobacterial globin//KE2 family protein//Adhesin lipoprotein
FCBBF10005980//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//AN1-like Zinc finger//Zinc finger, C2H2 type//Zinc finger, C2H2 type//Zinc finger, C2H2 type//Zinc finger, C2H2 type//Zinc finger, C2H2 type//Zinc finger, C2H2 type
FCBBF10006870//Corticotropin-releasing factor family
FCBBF20000940//Homeobox domain
FCBBF20002320//T-box
FCBBF20002760//Kelch motif//Kelch motif//Kelch motif
FCBBF20005910//Adenylate kinase//Viral (Superfamily 1) RNA helicase//TPR Domain//TPR Domain
FCBBF20008150//LIM domain containing proteins//LIM domain containing proteins//LIM domain containing proteins
FCBBF20009510//KRAB box//Zinc finger, C2H2 type//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type
FCBBF20012110//Myc amino-terminal region
FCBBF20015380//GNS1/SUR4 family
FCBBF20016720//Domain of unknown function DUF94
FCBBF40002820//Electron transfer flavoprotein beta subunit
FCBBF50002619//Zinc finger, C2H2 type//Zinc finger, C2H2 type//Zinc finger, C2H2 type//PHD-finger//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
FEBRA20000530//BTB/POZ domain//Kelch motif//Kelch motif//Kelch motif//Kelch motif//Kelch motif
FEBRA20001050//TPR Domain//TPR Domain//TPR Domain//TPR Domain//PPR repeat//TPR Domain
FEBRA20003770//Ank repeat//Iron/manganese superoxide dismutases (SODM)//Ras association (RalGDS/AF-6) domain//FERM domain (Band 4.1 family)
FEBRA20003970//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//TRAF-type zinc finger//Zinc finger, C2H2 type FEBRA20003990//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type FEBRA20004150//STAS domain FEBRA20004540//Zinc finger, C2H2 type//Zinc finger, C2H2 type//BolA-like protein//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type FEBRA20005360//Cystatin domain FEBRA20007330//EF hand//EF hand FEBRA20007870//Zinc finger, C2H2 type//Zinc finger, C2H2 type//Zinc finger, C2H2 type//Zinc finger, C2H2 type//Zinc finger, C2H2 type FEBRA20008560//Importin beta binding domain//Armadillo/beta-catenin-like repeats FEBRA20008810//Actin FEBRA20009720//KRAB box//Zinc finger, C2H2 type//Zinc finger, C2H2 type//Zinc finger, C2H2 type//Zinc finger, C2H2 type//Zinc finger, C2H2 type//BolA-like protein//Zinc finger, C2H2 type//Zinc finger, C2H2 type//Zinc finger, C2H2 type//Zinc finger, C2H2 type//Zinc finger, C2H2 type//Zinc finger, C2H2type//Zinc finger, C2H2 type FEBRA20011330//Trypsin and protease inhibitors//PCI domain FEBRA20011460//SCAN domain FEBRA20012450//Leucine rich repeat N-terminal domain//Leucine Rich Repeat//Leucine Rich Repeat//Leucine Rich Repeat//Leucine Rich Repeat//Leucine Rich Repeat//Leucine Rich Repeat//Leucine Rich Repeat//Leucine rich repeat C-terminal domain//Immunoglobulin domain//Fibronectin type III domain FEBRA20014920//S-adenosylmethionine synthetase FEBRA20015840//EGF-like domain//EGF-like domain//EGF-like domain//EGF-like domain//EB module//EGF-like domain//EGF-like domain FEBRA20017060//Immunoglobulin domain FEBRA20017150//Zinc finger, C3HC4 type (RING finger)//Zinc finger, C3HC4 type (RING finger)//Insulin-like growth factor binding proteins//B-box zinc finger.//CONSTANS family zinc finger//B-box zinc finger.//Putative zinc finger in N-recognin//Fibronectin type III domain//SPRY domain FEBRA20019890//PH domain//Putative GTP-ase activating protein for Arf//Ank repeat//Ank repeat FEBRA20024290//RNA polymerase alpha subunit FEBRA20024420//GMC oxidoreductases FEBRA20025250//TBC domain FEBRA20034290//CAP-Gly domain FEBRA20043250//Ank repeat//Ank repeat//Ank repeat//Ank repeat//Ank repeat//Homeobox associated leucine zipper FEBRA20043290//Myosin tail//lactate/malate dehydrogenase//Troponin//Domain present in Hsp70 regulators//Interleukin-6/G-CSF/MGF family//Myosin tail FEBRA20044900//Pou domain—N-terminal to homeobox domain//Spectrin repeat//Spectrin repeat FEBRA20045920//Glycoprotease family FEBRA20050140//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type FEBRA20050790//Protein-tyrosine phosphatase//Dual specificity phosphatase, catalytic domain FEBRA20057260//TBC domain FEBRA20057880//PDZ domain (Also known as DHR or GLGF).

FEBRA20060920//DIX domain

FEBRA20062700//haloacid dehalogenase-like hydrolase

FEBRA20064760//Zinc finger, C2H2 type//Zinc finger, C2H2 type//Zinc finger, C2H2 type//Zinc finger, C2H2 type//Zinc finger, C2H2 type//DM DNA binding domain//Zinc finger, C2H2 type//Zinc finger, C2H2 type//Zinc finger, C2H2 type//Zinc finger, C2H2 type//Zinc finger, C2H2 type//GATA zinc finger//Zinc finger, C2H2 type//Zinc finger, C2H2 type//Zinc finger, C2H2 type//PHD-finger//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type FEBRA20066670//Transthyretin precursor (formerly prealbumin)

FEBRA20067360//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type FEBRA20069420//KRAB box//Zinc finger, C2H2 type//Ribosomal protein L37e//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type FEBRA20070170//PX domain FEBRA20072000//TPR Domain//TPR Domain//TPR Domain//TPR Domain//TPR Domain//TPR Domain FEBRA20075510//Ras family HCASM20002140//Cyclin HCASM20003070//RNA recognition motif. (a.k.a. RRM, RBD, or RNP domain)

HEART20004110//POT family

HEART20005060//Occludin/ELL family//K-box region

HEART20005680//Nerve growth factor family

HHDPC20000550//Viral (Superfamily 1) RNA helicase//NB-ARC domain//Adenylate kinase//Adenylate kinase HHDPC20000950//Extracellular link domain//Lectin C-type domain HHDPC20001150//Collagen triple helix repeat (20 copies)//C1q domain HHDPC20001490//UBA domain//Integrase Zinc binding domain//IBR domain//IBR domain HHDPC20003150//Zn-finger in Ran binding protein and others.//Zinc knuckle HHDPC20004550//FERM domain (Band 4.1 family)

HHDPC20004560//2S seed storage family

HHDPC20004620//FAD binding domain

HLUNG10000240//Transforming growth factor beta like domain

HLUNG10000370//TPR Domain//TPR Domain//TPR Domain//TPR Domain

HLUNG10000760//HMG (high mobility group) box

HLUNG10000990//Adenosylmethionine decarboxylase

HLUNG20000680//KRAB box//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//Zinc finger, C2H2 type//Zinc finger, C2H2 type HLUNG20001420//REV protein (anti-repression transactivator protein)//Bacteriorhodopsin//Photosystem II reaction centre T protein//Sugar (and other) transporter//FecCD transport family
HLUNG20001760//Transthyretin precursor (formerly prealbumin)
HLUNG20002550//Trypsin
HSYRA10001190//TBC domain
HSYRA10001370//KRAB, box//Zinc finger, C2H2 type//Zinc finger, C2H2 type//Zinc finger, C2H2 type//PHD-finger//Zinc finger, C2H2 type//Zinc finger, C2H2 type//BolA-like protein//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
HSYRA10001680//DEAD/DEAH box helicase
HSYRA10001780//Alpha-2-macroglobulin family N-terminal region
HSYRA20001350//F-box domain.//Kelch motif//Kelch motif//Kelch motif
HSYRA20005100//UvrD/REP helicase
HSYRA20013320//Insulin-like growth factor binding proteins//Thyroglobulin type-1 repeat
HSYRA20014760//von Willebrand factor type A domain
HSYRA20015740//Glucosamine-6-phosphate isomerase
HSYRA20016210//HesB-like domain
HSYRA20016310//Zinc finger, C2H2 type//Zinc finger, C2H2 type//Zinc finger, C2H2 type//PHD-finger//Zinc finger, C2H2 type//Phorbol esters/diacylglycerol binding domain (C1 domain)//Zinc finger, C2H2 type
IMR3210000440//ATP1G1/PLM/MAT8 family//Eukaryotic protein kinase domain
IMR3210001580//Extracellular link domain//Lectin C-type domain
IMR3210002420//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
IMR3210002660//Cation efflux family
IMR3220002230//FHA domain//HIT family
IMR3220003020//Src homology domain 2
IMR3220007420//Zinc finger, C2H2 type
IMR3220007750//Nerve growth factor family//Kazal-type serine protease inhibitor domain//Thyroglobulin type-1 repeat//EF hand//Immunoglobulin domain//Immunoglobulin domain
IMR3220008380//Formyl transferase
IMR3220009190//Influenza Matrix protein (M1)//metallopeptidase family M24
IMR3220009730//Kinesin motor domain
IMR3220012180//tRNA pseudouridine synthase
IMR3220013170//Dual specificity phosphatase, catalytic domain
KIDNE10001040//Myb-like DNA-binding domain//Apolipoprotein A1/A4/E family//Thymidylate kinase//SNAP-25 family//Syntaxin
KIDNE20000410//Aminotransferases class-III pyridoxal-phosphate
KIDNE20000510//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//AN1-like Zinc finger//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type
KIDNE20001670//Sugar (and other) transporter
KIDNE20003150//Major intrinsic protein
KIDNE20003300//DnaJ domain
KIDNE20003490//Ubiquitin family//Viral matrix protein//Src homology domain 2//Acyltransferase
KIDNE20003750//C2 domain
KIDNE20004030//RNA helicase
KIDNE20004970//Kinesin motor domain//K-box region
KIDNE20005130//Aminotransferases class-III pyridoxal-phosphate//Aminotransferases class-III pyridoxal-phosphate
KIDNE20005170//Uncharacterized membrane protein family UPF0013
KIDNE20031850//Ras association (RalGDS/AF-6) domain
KIDNE20033050//Amidase//Amidase
KIDNE20033730//SH3 domain//RhoGEF domain//PH domain
KIDNE20039940//DNA gyrase/topoisomerase IV, subunit A//SCAN domain//Zinc finger, C2H2 type//Zinc finger, C2H2 type
KIDNE20040840//Eukaryotic protein kinase domain//Phosphoribulokinase//Myosin head (motor domain)//Myosin head (motor domain)
KIDNE20043440//Ribosomal protein L36
KIDNE20044110//Viral methyltransferase//V-type ATPase 116 kDa subunit family
KIDNE20046810//Dienelactone hydrolase family
KIDNE20048280//Amino acid permease//Sodium:neurotransmitter symporter family
KIDNE20050420//Herpesvirus UL25 family//Beige/BEACH domain//WD domain, G-beta repeat//WD domain, G-beta repeat//WD domain, G-beta repeat//WD domain, G-beta repeat//WD domain, G-beta repeat//AN1-like Zinc finger//FYVE zinc finger
KIDNE20052960//Actin
KIDNE20054770//Transmembrane amino acid transporter protein//Ion transport protein//Amino acid permease
KIDNE20056290//Acetyltransferase (GNAT) family
KIDNE20056760//Calponin homology (CH) domain
KIDNE20059080//Armadillo/beta-catenin-like repeats//Armadillo/beta-catenin-like repeats//Armadillo/beta-catenin-like repeats
KIDNE20060140//WD domain, G-beta repeat//WD domain, G-beta repeat//WD domain, G-beta repeat//WD domain, G-beta repeat//WD domain, G-beta repeat
KIDNE20060300//MutT-like domain
KIDNE20060530//Glycosyl transferase family 8
KIDNE20061490//SPRY domain
KIDNE20062480//Scorpion short toxins
KIDNE20062990//PH domain
KIDNE20066520//Bacterial extracellular solute-binding proteins, family 5
KIDNE20067600//Immunoglobulin domain//Immunoglobulin domain
KIDNE20073520//WW domain
KIDNE20075690//PMP-22/EMP/MP20/Claudin family
KIDNE20078100//Ribosomal protein L15//Integrase core domain//dUTPase
KIDNE20078110//KRAB box//Zinc finger, C2H2 type//Zinc finger, C2H2 type//Zinc finger, C2H2 type//Zinc finger, C2H2 type//PHD-finger//Zinc finger, C2H2 type
LIVER10000670//Urocanase
LIVER10001040//AMP-binding enzyme
LIVER10002300//Respiratory-chain NADH dehydrogenase 51 Kd subunit
LIVER10004330//Cyclic nucleotide-binding domain//Glutathione S-transferases.//Uncharacterized protein family UPF0028
LIVER10005420//Bowman-Birk serine protease inhibitor family LIVER20000330//Peptidase family M1//K+ channel tetramerisation domain
LIVER20000370//Immunoglobulin domain//Immunoglobulin domain//Immunoglobulin domain
MAMGL10000560//K-box region
MAMGL10001780//Lumenal portion of Cytochrome b559, alpha (gene psbE) subunit.
MAMGL10001820//DIX domain
MESAN10000350//Neurohypophysial hormones, C-terminal Domain
MESAN10001800//Sterol 0-acyltransferase
MESAN20000920//SAM domain (Sterile alpha motif)//PDZ domain (Also known as DHR or GLGF).//Phosphatidylinositol 3- and 4-kinases
MESAN20005010//PWWP domain
NB9N410000470//WD domain, G-beta repeat//WD domain, G-beta repeat//WD domain, G-beta repeat//WD domain, G-beta repeat
NB9N410001350//lactate/malate dehydrogenase//Ras family
NB9N420001040//Na+/K+ ATPase C-terminus
NHNPC10000840//RNA recognition motif. (a.k.a. RRM, RBD, or RNP domain)//RNA recognition motif. (a.k.a. RRM, RBD, or RNP domain)
NHNPC20002060//DnaJ domain
NHNPC20002120//Zinc finger, C2H2 type//Zinc finger, C2H2 type//Zinc finger, C2H2 type//Putative zinc finger in N-recognin//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2NE10000140//Zinc knuckle//Nucleotidyltransferase domain//Zinc knuckle
NT2NE10000730//Leucine Rich Repeat//Leucine Rich Repeat//Leucine Rich Repeat
NT2NE10000830//7 transmembrane receptor (rhodopsin family)
NT2NE10001850//Divalent cation transporter//TPR Domain//TPR Domain//TPR Domain//TPR Domain//TPR Domain//TPR Domain//TPR Domain//TPR Domain//TPR Domain
NT2NE20001740//RNA pseudouridylate synthase
NT2NE20002140//Rhodanese-like domain//Protein-tyrosine phosphatase//Dual specificity phosphatase, catalytic domain
NT2NE20002590//Zinc finger, C2H2 type//Zinc finger, C2H2 type//Zinc finger, C2H2 type//TRAF-type zinc finger//Zinc finger, C2H2 type
NT2NE20003690//Carbamoyl-phosphate synthase (CPSase)
NT2NE20003840//TPR Domain//TPR Domain//TPR Domain
NT2NE20005360//Ribosomal protein S2
NT2NE20005500//Retroviral aspartyl protease//Retroviral aspartyl protease
NT2NE20006580//Zinc finger, C3HC4 type (RING finger)//ICE-like protease (caspase) p10 domain//SPRY domain
NT2NE20007630//Matrix protein (MA), p15
NT2NE20008090//KRAB box//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2NE20013370//SPRY domain
NT2NE20013720//Tryptophan synthase alpha chain//Ribulose-phosphate 3 epimerase family//Indole-3-glycerol phosphate synthases
NT2NE20016260//7 transmembrane receptor (rhodopsin family)
NT2NE20016660//DEAD/DEAH box helicase
NT2NE20034080//EGF-like domain//Laminin EGF-like (Domains III and V)
NT2NE20047160//Glycosyl transferase family 8
NT2NE20053710//Ank repeat
NT2NE20057200//Ubiquitin-conjugating enzyme//DNA mismatch repair proteins, mutS family
NT2RI10000270//Zinc finger C-x8-C-x5-C-x3-H (SEQ ID NO: 3381) type (and similar).
NT2RI10000480//Dual specificity phosphatase, catalytic domain
NT2RI20003410//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//DM DNA binding domain//Zinc finger, C2H2 type//Zinc finger, C2H2 type//Zinc finger, C2H2 type//PHD-finger//Zinc finger, C2H2 type
NT2RI20004120//ENTH domain//DNA polymerase (viral) C-terminal domain
NT2RI20004210//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type
NT2RI20006690//Plant thionins
NT2RI20006850//Collagen triple helix repeat (20 copies)//Histone-like transcription factor (CBF/NF-Y) and archaeal histone
NT2RI20010100//Carboxylesterases//Carboxylesterases
NT2RI20010830//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2RI20014090//ROK family//Spectrin repeat//Tropomyosins//Spectrin repeat//Spectrin repeat
NT2RI20014500//Xylose isomerase
NT2RI20015400//TPR Domain
NT2RI20015950//Keratin, high sulfur B2 protein
NT2RI20016210//Bacterial regulatory proteins, luxR family
NT2RI20016570//DnaJ central domain (4 repeats)
NT2RI20018460//Glutamine synthetase//Notch (DSL) domain//Notch (DSL) domain
NT2RI20018660//Immunoglobulin domain//SPRY domain
NT2RI20020220//Phosphatidylinositol-specific phospholipase C, X domain
NT2RI20025170//PDZ domain (Also known as DHR or GLGF).//PDZ domain (Also known as DHR or GLGF).
NT2RI20025300//Ubiquitin family
NT2RI20025410//Zinc finger, C2H2 type//Zinc finger, C2H2 type//Putative zinc finger in N-recognin//Zinc finger, C2H2 type//Zinc finger, C2H2 type//Transcription factor S-II (TFIIS)//Zinc finger, C2H2 type//Zinc finger, C2H2 type//Zn-finger in ubiquitin-hydrolases and other proteins//Zinc finger, C2H2 type//Zinc finger, C2H2 type//Zinc finger, C2H2 type//Zinc finger, C2H2 type
NT2RI20025540//TPR Domain//TPR Domain//TPR Domain NT2RI20025850//jmjN domain//jmjC domain
NT2RI20029580//C2 domain//C2 domain
NT2RI20029700//EF hand//EF hand
NT2RI20030110//Immunoglobulin domain
NT2RI20031540//Interleukin-6/G-CSF/MGF family
NT2RI20032050//Armadillo/beta-catenin-like repeats//Armadillo/beta-catenin-like repeats
NT2RI20033440//PDZ domain (Also known as DHR or GLGF).
NT2RI20036780//Subtilase family//Proprotein convertase P-domain
NT2RI20036950//Leucine Rich Repeat//Leucine Rich Repeat//Leucine Rich Repeat//Leucine Rich Repeat//Leucine Rich Repeat//Leucine Rich Repeat//Insulin/IGF/Relaxin family//Ribosomal RNA adenine dimethylases//SAM domain (Sterile alpha motif)//TFIIE alpha subunit//Zinc finger, C3HC4 type (RING finger)
NT2RI20037510//Formamidopyrimidine-DNA glycosylase
NT2RI20046060//K+ channel tetramerisation domain
NT2RI20049850//Domain of unknown function
NT2RI20050610//Peptidase family M1
NT2RI20050870//Voltage gated chloride channels//Xanthine/uracil permeases family//Sulfate transporter family//STAS domain
NT2RI20051500//Sialyltransferase family//Photosynthetic reaction center protein
NT2RI20053680//Zinc finger, C2H2 type
NT2RI20055640//Glutathione S-transferases.//Protein of unknown function
DUF61//Glutathione S-transferases.
NT2RI20056470//bZIP transcription factor//Transposase//bZIP transcription factor//Outer membrane efflux protein//Intermediate filament proteins
NT2RI20058110//Guanine nucleotide exchange factor for Ras-like GTPases; N-terminal motif//RasGEF domain
NT2RI20060710//Zinc finger, C2H2 type//Zinc finger, C2H2 type//Zinc finger, C2H2 type//TRAF-type zinc finger//Zinc finger, C2H2 type//Zinc finger, C2H2 type
NT2RI20062100//Src homology domain 2
NT2RI20064120//Ras family//Cell division protein
NT2RI20066790//Immunoglobulin domain
NT2RI20067030//L1 (late) protein
NT2RI20067350//Zinc finger, C2H2 type//Zinc finger, C2H2 type//Zinc finger, C2H2 type//Zinc finger, C2H2 type//TRAF-type zinc finger//Zinc finger, C2H2 type//Zinc finger, C2H2 type//Zinc finger, C2H2 type//Zinc finger, C2H2 type//Zinc finger, C2H2 type
NT2RI20068250//Dolichyl-phosphate-mannose-protein mannosyltransferase//S-adenosylmethionine synthetase
NT2RI20068550//Helicases conserved C-terminal domain
NT2RI20070480//Atrial natriuretic peptide
NT2RI20070840//Immunoglobulin domain
NT2RI20070960//Hydroxymethylglutaryl-coenzyme A reductase//RhoGEF domain//Hpt domain//PH domain
NT2RI20071330//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2RI20071480//WD domain, G-beta repeat//WD domain, G-beta repeat//WD domain, G-beta repeat//WD domain, G-beta repeat//WD domain, G-beta repeat
NT2RI20072540//Ribosomal RNA adenine dimethylases//SAM domain (Sterile alpha motif)//TFIIE alpha subunit//Zinc finger, C3HC4 type (RING finger)
NT2RI20073840//Eukaryotic protein kinase domain
NT2RI20074390//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2RI20074690//Ubiquinol-cytochrome C reductase complex 14 kD subunit
NT2RI20074980//Fz domain//Zinc carboxypeptidase//Zinc carboxypeptidase
NT2RI20078270//Acyl-CoA oxidase
NT2RI20078840//Homeobox domain//Bacterial regulatory proteins, crp family//Site-specific recombinases//Bacterial regulatory proteins, luxR family
NT2RI20078910//WD domain, G-beta repeat//WD domain, G-beta repeat//WD domain, G-beta repeat//WD domain, G-beta repeat//WD domain, G-beta repeat
NT2RI20080500//Immunoglobulin domain//Immunoglobulin domain//Immunoglobulin domain//Immunoglobulin domain//Immunoglobulin domain//Immunoglobulin domain
NT2RI20083360//bZIP transcription factor
NT2RI20084810//Acyltransferase
NT2RI20085980//Bacterial regulatory proteins, crp family//CUB domain//F5/8 type C domain
NT2RI20087140//SET domain
NT2RI20088120//Bindin//HupF/HypC family
NT2RI20089420//Immunoglobulin domain//PKD domain
NT2RI20090650//Zinc finger, C2H2 type//Zinc finger, C2H2 type//Zinc finger, C2H2 type//Zinc finger, C2H2 type//Zinc finger, C3HC4 type (RING finger)//Zinc finger, C2H2 type//Zinc finger, C2H2 type//Zinc finger, C2H2 type//Zinc finger, C3HC4 type (RING finger)//Zinc finger, C2H2 type//Putative zinc finger in N-recognin//Zinc finger, C2H2 type//Zinc finger, C2H2 type//Zinc finger, C2H2 type
NT2RI20091440//SPRY domain
NT2RI20092150//SCAN domain//Integrase core domain
NT2RI20092890//Leucine rich repeat N-terminal domain//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine rich repeat C-terminal domain//Immunoglobulin domain
NT2RI20094060//DHHC zinc finger domain
NT2RP60000320//Cytochrome c oxidase subunit III//7 transmembrane receptor (Secretin family)//Domain found in Dishevelled, Egl-10, and Pleckstrin
NT2RP60000720//Molluscan rhodopsin C-terminal tail
NT2RP60000860//Ubiquitin-conjugating enzyme
NT2RP60001000//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//TRAF-type zinc finger//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2RP60001090//BTB/POZ domain//HMG (high mobility group) box//Kelch motif//Kelch motif//Kelch motif//Kelch motif//Kelch motif
NT2RP60001230//TPR Domain//TPR Domain//TPR Domain//TPR Domain//PPR repeat//TPR Domain
NT2RP60001270//Zinc finger, C2H2 type//Zinc finger, C2H2 type//Zinc finger, C2H2 type//TRAF-type zinc finger//Zinc finger, C2H2 type//Zinc finger, C2H2 type NT2RP70000690//Methyl-CpG binding domain
NT2RP70002380//Bacterial export proteins, family 3
NT2RP70002710//Zinc finger, C2H2 type//Zinc finger, C2H2 type
NT2RP70004770//TPR Domain//TPR Domain//TPR Domain//TPR Domain//TPR Domain//TPR Domain//TPR Domain
NT2RP70006240//Integrins, beta chain//RhoGEF domain//PH domain//MORN motif//MORN motif//MORN motif//MORN motif//MORN motif//Coproporphyrinogen III oxidase//MORN motif
NT2RP70010800//ZAP domain
NT2RP70011660//Iron/manganese superoxide dismutases (SODM)//E1-E2 ATPase//Domain of unknown function DUF19//Photosystem II reaction centre T protein
NT2RP70012310//Alphavirus E3 glycoprotein//RNA recognition motif. (a.k.a. RRM, RBD, or RNP domain)
NT2RP70015910//Kringle domain//WSC domain//CUB domain
NT2RP70018560//SAM domain (Sterile alpha motif)//Sterile alpha motif (SAM)/Pointed domain
NT2RP70023760//WD domain, G-beta repeat//WD domain, G-beta repeat//WD domain, G-beta repeat//WD domain, G-beta repeat//WD domain, G-beta repeat//TBC domain
NT2RP70024500//Picornavirus coat protein (VP4)//KRAB box//Zinc finger, C2H2 type//Zinc finger, C2H2 type//Zinc finger, C2H2 type//Zinc finger, C2H2 type//IBR domain//Zinc finger, C2H2 type//Zinc finger, C2H2 type
NT2RP70028750//Ank repeat//Ank repeat//Ank repeat//CAP-Gly domain
NT2RP70029060//Oxysterol-binding protein//Hsp90 protein
NT2RP70030550//PHD-finger
NT2RP70032030//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//GATA zinc finger//Zinc finger, C2H2 type//Zinc finger, C2H2 type//Zinc finger, C2H2 type//Zinc finger, C2H2 type
NT2RP70033040//Rhodanese-like domain//Integrase Zinc binding domain//Integrase Zinc binding domain//DnaJ central domain (4 repeats)
NT2RP70036290//Glypican//Leucine Rich Repeat//Leucine Rich Repeat
NT2RP70036470//Porphobilinogen deaminase//GHMP kinases putative ATP-binding proteins
NT2RP70036800//Methanol dehydrogenase beta subunit//BTB/POZ domain//Kelch motif//Kelch motif//Kelch motif//Kelch motif//Kelch motif//Kelch motif
NT2RP70039600//Calpain inhibitor repeat
NT2RP70042040//PHD-finger//FYVE zinc finger//Zinc finger, C2H2 type//Zinc finger, C2H2 type//Zinc finger, C2H2 type//Zinc finger, C2H2 type//Zinc finger, C2H2 type
NT2RP70042330//TPR Domain//TPR Domain//TPR Domain//TPR Domain//TPR Domain//TPR Domain//TPR Domain
NT2RP70043960//SH3 domain//SH3 domain//SH3 domain//SH3 domain//SH3 domain
NT2RP70045410//Helix-loop-helix DNA-binding domain
NT2RP70046560//PHD-finger//PHD-finger
NT2RP70046870//Macrophage migration inhibitory factor (MIF)//WD domain, G-beta repeat//WD domain, G-beta repeat//WD domain, G-beta repeat//WD domain, G-beta repeat//WD domain, G-beta repeat//Arenavirus glycoprotein//WD domain, G-beta repeat
NT2RP70049150//PWWP domain
NT2RP70049250//WH1 domain
NT2RP70055020//Sigma-54 interaction domain//ATPases associated with various cellular activities (AAA)
NT2RP70055130//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//TRAF-type zinc finger//Zinc finger, C2H2 type//Zinc finger, C2H2 type//DM DNA binding domain//Zinc finger, C2H2 type
NT2RP70061620//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
NT2RP70061880//GTPase-activator protein for Ras-like GTPase
NT2RP70062960//SNF2 and others N-terminal domain//SNF2 and others N-terminal domain//Leishmanolysin//Helicases conserved C-terminal domain
NT2RP70063040//Plant PEC family metallothionein//Cell division protein
NT2RP70064900//KRAB box//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//TRAF-type zinc finger//Zinc finger, C2H2 type
NT2RP70065270//LIM domain containing proteins//LIM domain containing proteins//LIM domain containing proteins//Helper component proteinase
NT2RP70069860//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Putative zinc finger in N-recognin//Zinc finger, C2H2 type//DM DNA binding domain//Zinc finger, C2H2 type
NT2RP70071770//STAT protein//Zinc finger, C3HC4 type (RING finger)
NT2RP70072210//Viral (Superfamily 1) RNA helicase
NT2RP70072520//PAS domain//PAS domain//PAS domain//Eukaryotic protein kinase domain
NT2RP70074060//Glutamine synthetase
NT2RP70075370//Zinc finger, C3HC4 type (RING finger)//B-box zinc finger.//CONSTANS family zinc i finger//Putative zinc finger in N-recognin//SPRY domain
NT2RP70076100//SAM domain (Sterile alpha motif)
NT2RP70076430//Apolipoprotein A1/A4/E family
NT2RP70079250//F5/8 type C domain//Laminin G domain//Laminin G domain//EGF-like domain//Thrombospondin N-terminal-like domains//Laminin G domain
NT2RP70079750//Laminin G domain
NT2RP70081370//Herpesvirus glycoprotein M//ABC transporter//Ribosomal S17
NT2RP70081440//Eukaryotic protein kinase domain
NT2RP70081670//Helix-hairpin-helix motif.//S1 RNA binding domain
NT2RP70084060//Glycosyl transferases group 1
NT2RP70084410//Bromodomain//Bromodomain//Bromodomain//Bromodomain//Bromodomain//Bromodomain//BAH domain NT2RP70084870//Sulfotransferase proteins NT2RP70085500//Immunoglobulin domain//Immunoglobulin domain//Immunoglobulin domain//Immunoglobulin domain//Fibronectin type III domain//Fibronectin type III domain//Fibronectin type III domain NT2RP70085570//Heavy-metal-associated domain//HECT-domain (ubiquitin-transferase).

NT2RP70087200//KRAB box//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//DM DNA binding domain//Zinc finger, C2H2 type//Zinc finger, C2H2 type//Zinc finger, C2H2 type//Zinc finger, C2H2 type//Zinc finger, C2H2 type NT2RP70088550//PH domain NT2RP70090120//Cytochrome oxidase subunit II//voltage gated chloride channels//CBS domain//CBS domain NT2RP70090190//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type NT2RP70091490//Sugar (and other) transporter NT2RP70092360//Immunoglobulin domain//Immunoglobulin domain//Immunoglobulin domain//Immunoglobulin domain//Immunoglobulin domain//Immunoglobulin domain//Thioredoxin//Immunoglobulin domain//Immunoglobulin domain//Immunoglobulin domain//Thioredoxin//Immunoglobulin domain//Adenovirus E3 region protein CR1//Immunoglobulin domain//Immunoglobulin domain//Immunoglobulin domain//Immunoglobulin domain NT2RP70093220//CbiM//Voltage gated chloride channels//CBS domain//CBS domain NT2RP70093700//WD domain, G-beta repeat//Virion host shutoff protein//WD domain, G-beta repeat//WD domain, G-beta repeat//WD domain, G-beta repeat//WD domain, G-beta repeat//WD domain, G-beta repeat NT2RP70093940//IPT/TIG domain NT2RP70094810//Myelin proteolipid protein (PLP or lipophilin)//Influenza non-structural protein (NS1)//Protein of unknown function DUF67//Patched family//7 transmembrane receptor (metabotropic glutamate family)

NT2RP70094980//EGF-like domain//EGF-like domain//Trypsin Inhibitor like cysteine rich domain//EGF-like domain//EGF-like domain//Trypsin Inhibitor like cysteine rich domain//EGF-like domain//von Willebrand factor type C domain//von Willebrand factor type C domain//Metallothionein//von Willebrand factor type C domain//von Willebrand factor type C domain//von Willebrand factor type C domain//von Willebrand factor type C domain NTONG10000520//BTB/POZ domain//Kelch motif//Kelch motif NTONG10001300//HlyD family secretion protein//Biopterin-dependent aromatic amino acid hydroxylase//Caspase recruitment domain NTONG10002570//Rhabdovirus spike glycoprotein NTONG10002640//Phosphoglucomutase/phosphomannomutase NTONG20003340//Zinc finger, C2H2 type//Zinc finger, C2H2 type//Zinc finger, C2H2 type//Zinc finger, C2H2 type//Zinc finger, C2H2 type//Zinc finger, C2H2 type NTONG20008780//Bacterial regulatory proteins, lacI family//Site-specific recombinases NTONG20009660//Nebulin repeat//Nebulin repeat//Nebulin repeat//Nebulin repeat//Nebulin repeat//Nebulin repeat//Nebulin repeat//Nebulin repeat NTONG20015500//Zinc finger, C2H2 type//Zinc finger, C2H2 type//Zinc finger, C2H2 type//Zinc finger, C2H2 type//BolA-like protein//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//Zinc finger, C2H2 type NTONG20016120//PH domain//Phosphoglycerate mutase family//Oxysterol-binding protein 0CBBF10000910//Sorbin homologous domain//Peptidase family M1//SH3 domain//SH3 domain//SH3 domain 0CBBF10001180//K+ channel tetramerisation domain 0CBBF10001190//DNA topoisomerase II (N-terminal region)

0CBBF10001220//BTB/POZ domain//Kelch motif//Kelch motif//Kelch motif//Kelch motif//Kelch motif 0CBBF20002310//Leucine rich repeat N-terminal domain//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Leucine rich repeat C-terminal domain 0CBBF20007190//Metallo-beta-lactamase superfamily 0CBBF20008240//bZIP transcription factor//tRNA synthetase class II (G, H, P, S and T)

0CBBF20010750//Spectrin repeat

0CBBF20011010//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//FYVE zinc finger//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type 0CBBF20011240//Glutathione S-transferases.

0CBBF20011400//WD domain, G-beta repeat//K+ channel tetramerisation domain//7-fold repeat in Clathrin and VPS 0CBBF20011760//BTB/POZ domain//Kelch motif//Kelch motif//Kelch motif//Kelch motif//Kelch motif 0CBBF20012100//PAP2 superfamily 0CBBF20013070//Zinc finger, C2H2 type//Zinc finger, C2H2 type 0CBBF20014940//UBA domain 0CBBF20015270//Zinc finger, C2H2 type//Bacterial type II secretion system protein 0CBBF20015280//lactate/malate dehydrogenase 0CBBF20015860//ATP synthase Alpha chain, C terminal PEBLM10000340//RNA recognition motif. (a.k.a. RRM, RBD, or RNP domain)//Zn-finger in Ran binding protein and others.

PEBLM10000680//Actin

PEBLM20001120//Thymidylate kinase//Leucine Rich Repeat//Leucine Rich Repeat//Leucine Rich Repeat//Leucine Rich Repeat//Leucine Rich Repeat PEBLM20002480//KRAB box//Zinc finger, C2H2 type//Zinc finger, C2H2 type//Zinc finger, C2H2 type//TRAF-type zinc finger//Zinc finger, C2H2 type//Transcription factor S-II (TFIIS)//Zinc finger, C2H2 type//Zinc finger, C2H2 type//Zinc finger, C2H2 type PEBLM20002700//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//Zinc finger, C2H2 type
PEBLM20003080//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
PEBLM20003950//SCAN domain
PEBLM20004790//Src homology domain 2//Eukaryotic protein kinase domain
PLACE50000370//7-fold repeat in Clathrin and VPS
PLACE50000580//Apolipoprotein A1/A4/E family
PLACE50000680//Sushi domain (SCR repeat)//Sushi domain (SCR repeat)
PLACE60002050//Zinc finger, C2H2 type//Zinc finger, C2H2 type//Zinc finger, C2H2 type//Zinc finger, C2H2 type
PLACE60003790//Lumenal portion of Cytochrome b559, alpha (gene psbE) subunit.
PLACE60004290//Gag P30 core shell protein
PLACE60012810//AMP-binding enzyme
PLACE60014430//moaA/nifB/pqqE family//MoaC family
PLACE60018860//Adenylate and Guanylate cyclase catalytic domain
PLACE60021020//Integrase Zinc binding domain//Integrase Zinc binding domain//DnaJ central domain (4 repeats)
PLACE60021510//KRAB box//Zinc finger, C2H2 type//Zinc finger, C2H2 type//Putative zinc finger in N-recognin//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
PLACE60026680//Sorbin homologous domain//SH3 domain//SH3 domain
PLACE60030380//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
PLACE60032040//Hirudin
PLACE60037050//ENV polyprotein (coat polyprotein)
PLACE60038500//Mitochondrial carrier proteins//Mitochondrial carrier proteins
PLACE60044640//Small cytokines (intecrine/chemokine), interleukin-8 like
PLACE60046630//Phorbol esters/diacylglycerol binding domain (C1 domain)//PHD-finger
PROST10003430//PHD-finger//Zinc finger, C3HC4 type (RING finger)//TRAF-type zinc finger//PDZ domain (Also known as DHR or GLGF).//PDZ domain (Also known as DHR or GLGF).//PDZ domain (Also known as DHR or GLGF).//WHEP-TRS domain containing proteins//PDZ domain (Also known as DHR or GLGF).
PROST10005360//F5/8 type C domain//Laminin G domain//Laminin G domain//EGF-like domain//Fibrinogen beta and gamma chains, C-terminal globular domain
PROST20003250//RNA recognition motif. (a.k.a. RRM, RBD, or RNP domain)
PROST20018230//Zinc finger, C2H2 type//Zinc finger, C2H2 type//Zinc finger, C2H2 type
PROST20018990//ADP-ribosylation factor family//Ras family
PROST20023380//K+ channel tetramerisation domain//BTB/POZ domain
PROST20029600//Small cytokines (intecrine/chemokine), interleukin-8 like//Immunoglobulin domain
PROST20031170//Heavy-metal-associated domain//HECT-domain (ubiquitin-transferase).
PROST20033380//TPR Domain//TPR Domain//TPR Domain
PROST20033400//Eukaryotic protein kinase domain
PROST20043320//Paramyxovirus nucleocapsid protein//SH3 domain
PROST20044160//Tropomyosins
PROST20051210//Protein phosphatase 2C//Protein phosphatase 2C
PROST20064500//Sulfotransferase proteins
PROST20067370//TRAF-type zinc finger//DnaJ central domain (4 repeats)
PROST20069880//Atrial natriuretic peptide
PROST20072890//K+ channel tetramerisation domain//BTB/POZ domain
PROST20073170//K+ channel tetramerisation domain//BTB/POZ domain//Zinc finger, C2H2 type//Zinc finger, C2H2 type//Zinc finger present in dystrophin, CBP/p300
PROST20073890//Platelet-derived growth factor (PDGF)
PROST20085160//Tropomyosins//Tropomyosins
PROST20094830//PH domain
PUAEN10003220//Photosystem I reaction centre subunit VIII
SALGL10000050//Permeases for cytosine/purines, uracil, thiamine, allantoin
SALGL10000650//SAM domain (Sterile alpha motif)//Sterile alpha motif (SAM)/Pointed domain
SALGL10001570//Colicin pore forming domain//MotA/TolQ/ExbB proton channel family
SKMUS10000140//Ubiquitin family//Ubiquitin family//Ubiquitin family//Ubiquitin family//Ubiquitin family//Ubiquitin family
SKMUS10000220//WD domain, G-beta repeat//WD domain, G-beta repeat//WD domain, G-beta repeat//WD domain, G-beta repeat//WD domain, G-beta repeat//WD domain, G-beta repeat
SKMUS10000640//Zinc finger, C3HC4 type (RING finger)//Zinc finger, C3HC4 type (RING finger)//PHD-finger//B-box zinc finger.//3'5'-cyclic nucleotide phosphodiesterase
SKMUS10001040//bZIP transcription factor
SKMUS10001180//Coronavirus S2 glycoprotein
SKMUS10001290//MutT-like domain
SKMUS10001770//Protein-L-isoaspartate(D-aspartate) 0-methyltransferase (PCMT)
SKMUS20000740//ubiE/C0Q5 methyltransferase family//Cyclopropane-fatty-acyl-phospholipid synthase
SKMUS20001170//ATP synthase Alpha chain, C terminal//MAGE family
SKMUS20002710//Hepatitis C virus capsid protein
SKMUS20003900//Mov34/MPN/PAD-1 family
SKMUS20004580//LIM domain containing proteins//Nebulin repeat//Nebulin repeat//Nebulin repeat//Nebulin repeat//Nebulin repeat//Nebulin repeat//Nebulin repeat//Nebulin repeat
SKMUS20007240//Thiamine pyrophosphate enzymes//Thiamine pyrophosphate enzymes//Thiamine pyrophosphate enzymes
SKMUS20008630//0B-fold nucleic acid binding domain//tRNA synthetases.class II (F)//tRNA synthetases class II (D, K and N)
SKMUS20009540//F-box domain.

SKMUS20011290//Iron-containing alcohol dehydrogenases//Iron-containing alcohol dehydrogenases
SKMUS20013640//Laminin EGF-like (Domains III and V)
SKMUS20016340//HMG (high mobility group) box
SKMUS20016620//Ank repeat//Ank repeat//Glutamine amidotransferases class-II//Ank repeat
SKMUS20016680//Phorbol esters/diacylglycerol binding domain (C1domain)//CONSTANS family zinc finger//SH3 domain
SKNMC10000290//Zinc finger C-x8-C-x5-C-x3-H (SEQ ID NO: 3381) type (and similar).
SKNMC10002510//ABC transporter transmembrane region.//Phosphoribulokinase//ATPases associated with various cellular activities (AAA)//ABC transporter
SKNMC20000650//Zinc finger, C2H2 type//Protein phosphatase 2C//Zinc finger, C2H2 type//Zinc finger, C2H2 type//Zinc finger, C2H2 type//Zinc finger, C2H2 type//Zinc finger, C2H2 type
SKNMC20000970//RNA recognition motif. (a.k.a. RRM, RBD, or RNP domain)//Elongation factor TS//Protein-L-isoaspartate(D-aspartate) O-methyltransferase (PCMT)//Met-10+ like-proteins
SKNMC20002240//KRAB box//Zinc finger, C2H2 type//LIM domain containing proteins//Zinc finger, C2H2 type//TRAF-type zinc finger//Zinc finger, C2H2 type//Zinc finger, C2H2 type//Zinc finger, C2H2 type//Zinc finger, C2H2 type//LIM domain containing proteins//PHD-finger//Zinc finger, C2H2 type
SKNMC20003560//Helix-loop-helix DNA-binding domain
SKNMC20010570//F-box domain.
SKNMC20015030//Keratin, high sulfur B2 protein
SKNMC20015960//Ank repeat//Ank repeat//Ank repeat//Ank repeat//Ank repeat//Ank repeat//Ank repeat//Ank repeat//Ank repeat//Ank repeat//Ank repeat//Ank repeat//Ank repeat//Ank repeat//Bacterial stress protein//Ank repeat//Formylmethanofuran-tetrahydromethanopterin formyltransferase//Ank repeat//Ank repeat//Ank repeat//Neuraxin and MAP1B proteins//FYVE zinc finger
SKNSH10001740//Pyridoxal-dependent decarboxylase
SKNSH10003010//SH3 domain
SKNSH20003470//Heme-binding domain in cytochrome b5 and oxidoreductases
SMINT10000160//UDP-glucoronosyl and UDP-glucosyl transferases
SMINT10000420//Cytochrome oxidase subunit II//ABC transporter//Biopterin-dependent aromatic amino acid hydroxylase
SMINT10000570//Immunoglobulin domain//Immunoglobulin domain//Immunoglobulin domain
SMINT10000710//Immunoglobulin domain
SMINT10001030//Ank repeat//Ank repeat//Ank repeat//Ank repeat//Ank repeat//Ank repeat//Ank repeat//Ank repeat//Ank repeat
SMINT20002270//Disintegrin//Trans-activation protein X
SMINT20002770//Transcriptional regulatory protein, C terminal//Immunoglobulin domain
SPLEN10001430//HMG (high mobility group) box
SPLEN20000720//Zinc finger, C2H2 type//Zinc finger, C2H2 type//Zinc finger, C2H2 type//TRAF-type zinc finger//Zinc finger, C2H2 type//Zinc finger, C2H2 type//Zinc finger, C2H2 type
SPLEN20001340//Peptidase family M20/M25/M40
SPLEN20001970//Transcription factor TFIIB repeat
SPLEN20002670//WD domain, G-beta repeat
SPLEN20003570//RasGEF domain//Ras association (RalGDS/AF-6) domain
STOMA10001860//Cytosolic long-chain acyl-CoA thioester hydrolase//OB-fold nucleic acid binding domain//Cytosolic long-chain acyl-CoA thioester hydrolase
STOMA20000880//Immunoglobulin domain
STOMA20001210//Cys/Met metabolism PLP-dependent enzyme//Aminotransferases class-I
STOMA20002570//MgtC family
STOMA20002890//Adaptin N terminal region
STOMA20003960//LIM domain containing proteins//LIM domain containing proteins
STOMA20004820//PH domain//EF hand//EF hand//Phosphatidylinositol-specific phospholipase C, X domain
SYNOV10001280//Lipoate-protein ligase B
SYNOV20013740//KRAB box//Bacterial type II secretion system protein I/J//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
SYNOV20014510//SRF-type transcription factor (DNA-binding and dimerisation domain)
SYNOV20016480//glycosyl transferase family
TESTI10000420//K-box region//Penicillin amidase
TESTI10000510//Transient receptor
TESTI10000550//Homeobox domain
TESTI10000640//K+ channel tetramerisation domain//BTB/POZ domain//Kelch motif//Kelch motif//Kelch motif//Kelch motif//Kelch motif
TESTI10000700//Ubiquitin carboxyl-terminal hydrolases family 2//Ubiquitin carboxyl-terminal hydrolase family 2
TESTI10001270//PLAT/LH2 domain//PLAT/LH2 domain//PLAT/LH2 domain
TESTI10001380//Subtilase family//Proprotein convertase P-domain
TESTI10001680//Leucine Rich Repeat//Leucine Rich Repeat//Leucine Rich Repeat//Leucine Rich Repeat//Leucine Rich Repeat//Leucine Rich Repeat
TESTI20001200//KRAB box
TESTI20001540//Eukaryotic protein kinase domain
TESTI20001770//von Willebrand factor type A domain//Proprotein convertase P-domain
TESTI20002070//NifU-like N terminal domain
TESTI20002380//Exonuclease//3'–5' exonuclease
TESTI20002530//Ubiquitin family
TESTI20003560//Tubulin/FtsZ family
TESTI20005910//Adenylate kinase//Elongation factor Tu family//Adenylate kinase//6-phosphofructo-2-kinase//Shikimate kinase//pKID domain//Adenylate kinase//Thymidylate kinase//ATPases associated with various cellular activities (AAA)
TESTI20006000//Ank repeat//CAP-Gly domain
TESTI20006270//TPR Domain//TPR Domain//TPR Domain//4-hydroxyphenylpyruvate dioxygenase C terminal domain//TPR Domain//TPR Domain
TESTI20006950//Tudor domain//Stathmin family
TESTI20006990//KOW motif//Kinesin motor domain
TESTI20007070//DM DNA binding domain
TESTI20007840//Apolipoprotein A1/A4/E family
TESTI20008490//Apolipoprotein A1/A4/E family
TESTI20008830//Immunoglobulin domain
TESTI20010490//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type TESTI20011410//RhoGEF domain//PH domain//Phorbol esters/diacylglycerol binding domain (C1 domain)//CXXC zinc finger//FYVE zinc finger//PH domain TESTI20012370//K+ channel tetramerisation domain//BTB/POZ domain//Ornithine decarboxylase antizyme//Kelch motif//Kelch motif//Kelch motif//Kelch motif//Kelch motif TESTI20012690//Biotin-requiring enzymes//Biotin-requiring enzymes//2-oxo acid dehydrogenases acyltransferase (catalytic domain)

TESTI20013300//EF hand//EF hand//Ubiquitin carboxyl-terminal hydrolases family 2

TESTI20013450//Double-stranded RNA binding motif//Aldehyde oxidase and xanthine dehydrogenase, C terminus//Adenosine-deaminase (editase) domain TESTI20014200//ABC 3 transport family//Sugar (and other) transporter TESTI20015110//bZIP transcription factor//Troponin//Domain of unknown function DUF87

TESTI20015560//K+ channel tetramerisation domain//BTB/POZ domain

TESTI20016610//Leptin

TESTI20018150//Zinc finger, C2H2 type//Zinc finger, C2H2 type//Zinc finger, C2H2 type//Zinc finger, C2H2 type//Zinc finger, C2H2 type TESTI20018270//Transketolase//Dehydrogenase E1 component//Transketolase TESTI20018520//F5/8 type C domain//Laminin G domain//Ribosomal protein L11//Thrombospondin N-terminal-like domains//Laminin G domain//EGF-like domain//Fibrinogen beta and gamma chains, C-terminal globular domain TESTI20018690//SAM domain (Sterile alpha motif)

TESTI20018790//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type TESTI20020570//E1 Protein, N terminal domain//Actin TESTI20020810//7 transmembrane receptor (metabotropic glutamate family)//Transmembrane amino acid transporter protein TESTI20021050//TPR Domain//TPR Domain//TPR Domain//TPR Domain//TPR Domain//TPR Domain//TPR Domain TESTI20021490//BTB/POZ domain//Zinc finger, C2H2 type//PHD-finger//Zinc finger, C2H2 type//Zinc finger, C2H2 type//Zinc finger, C2H2 type//Zinc finger, C2H2 type TESTI20022230//Nucleosome assembly protein (NAP)

TESTI20022510//Calreticulin family//PHD-finger

TESTI20022560//Leucine Rich Repeat//Leucine Rich Repeat//Leucine Rich Repeat//Leucine Rich Repeat//Leucine Rich Repeat//Leucine Rich Repeat//Leucine Rich Repeat//Leucine Rich Repeat//Guanylate kinase//Vesiculovirus phosphoprotein TESTI20024980//PDZ domain (Also known as DHR or GLGF).//SH3 domain//Guanylate kinase TESTI20025160//MAGE family TESTI20025800//lactate/malate dehydrogenase//Pyridine nucleotide-disulphide oxidoreductase TESTI20026760//SPRY domain TESTI20027070//Type I phosphodiesterase/nucleotide pyrophosphatase TESTI20027290//RhoGAP domain TESTI20027890//KRAB box//Dictyostelium (slime mold) repeats//Dictyostelium (slime mold) repeats//Zinc finger, C2H2 type//Dictyostelium (slime mold) repeats//Zinc finger, C2H2 type//Dictyostelium (slime mold) repeats TESTI20029120//Eukaryotic protein kinase domain TESTI20030050//Histone-like transcription factor (CBF/NF-Y) and archaeal histone TESTI20030370//MYND finger//TPR Domain//TPR Domain//TPR Domain//Adaptin N terminal region TESTI20030710//Herpesvirus UL25 family TESTI20031090//Armadillo/beta-catenin-like repeats//Armadillo/beta-catenin-like repeats//Armadillo/beta-catenin-like repeats//Armadillo/beta-catenin-like repeats//Armadillo/beta-catenin-like repeats//Armadillo/beta-catenin-like repeats//Armadillo/beta-catenin-like repeats//Armadillo/beta-catenin-like repeats TESTI20031300//TPR Domain TESTI20031520//mRNA capping enzyme TESTI20031960//WD domain, G-beta repeat TESTI20032280//Myb-like DNA-binding domain TESTI20033250//UBX domain//Orotidine 5'-phosphate decarboxylases TESTI20033270//DM DNA binding domain TESTI20033540//Zinc finger, C2H2 type TESTI20033560//F-box domain.

TESTI20034190//ATP synthase Alpha chain, C terminal//AMP-binding enzyme

TESTI20034980//RhoGEF domain

TESTI20035120//C2 domain//Kinesin motor domain

TESTI20035510//NOL1/NOP2/sun family

TESTI20035890//UBA domain//Zinc finger C-x8-C-x5-C-x3-H (SEQ ID NO: 3381) type (and similar).

TESTI20036250//TSC-22/dip/bun family//NAD dependent epimerase/dehydratase family//Adenylate kinase//ATPases associated with various cellular activities (AAA)

TESTI20037810//Eukaryotic protein kinase domain

TESTI20038940//IQ calmodulin-binding motif//IQ calmodulin-binding motif//IQ calmodulin-binding motif TESTI20040000//short chain dehydrogenase//3-beta hydroxysteroid dehydrogenase/isomerase family TESTI20040310//Protein of unknown function DUF84

TESTI20041220//VPR/VPX protein

TESTI20042870//ET module

TESTI20042950//3'5'-cyclic nucleotide phosphodiesterase//Peptidase family M1

TESTI20049820//Cyclic nucleotide-binding domain

TESTI20053960//KRAB box//Zinc finger, C2H2 type//Zinc finger, C2H2 type//Zinc finger, C2H2 type//Zinc finger, C2H2 type//Transcription factor S-II (TFIIS)//Zinc finger, C2H2 type//Zinc finger, C2H2 type//Zinc finger, C2H2 type//TRAF-type zinc finger//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Phorbol esters/diacylglycerol binding domain (C1 domain)//Zinc finger, C2H2 type//Zinc finger, C2H2 type//Zinc finger, C2H2 type//Zinc finger, C2H2 type TESTI20055840//PH domain//PH domain TESTI20056900//Urease, gamma subunit//IQ calmodulin-binding motif//IQ calmodulin-binding motif TESTI20057310//Tropomyosins TESTI20057420//Acyl CoA binding protein//Ribosomal Proteins L2

TESTI20064830//Tetrahydrofolate dehydrogenase/cyclohydrolase

TESTI20068660//Domain of unknown function DUF19//TPR Domain//TPR Domain//TPR Domain TESTI20068720//Zinc finger, C2H2 type//Zinc finger, C2H2 type TESTI20074640//KRAB box//Zinc finger, C2H2 type//MYND finger//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type
TESTI20074660//KRAB box//Zinc finger, C2H2 type//Zinc finger, C2H2 type//Zinc finger, C2H2 type//Zinc finger, C2H2 type//Zinc finger, C2H2 type//Zinc finger, C2H2 type//Zinc finger, C2H2 type//PHD-finger//Zinc finger, C2H2 type//Zinc finger, C2H2 type//Zinc finger, C2H2 type//Zinc finger, C2H2 type//MYND finger//Zinc finger, C2H2 type
TESTI20074800//Glypican
TESTI20077490//Signal peptidase (SPase) II
TESTI20078640//SCAN domain
TESTI20078720//ATP synthase B/B' CF(0)//Ribosomal L29 protein
TESTI20079510//Immunoglobulin domain//Immunoglobulin domain//Adenovirus E3 region protein CR1//Immunoglobulin domain//Immunoglobulin domain//Fibronectin type III domain//Fibronectin type III domain
TESTI20080200//MttB family UPF0032
TESTI20080330//Ribosomal protein L14p/L23e
TESTI20083430//TPR Domain
TESTI20083870//EF hand//EF hand//EF hand//Phosphatidylinositol 3- and 4-kinases//EF hand
TESTI20086570//MAGE family
TESTI20087740//TPR Domain//TPR Domain//Outer membrane efflux protein//TPR Domain//TPR Domain
TESTI20138320//Transketolase
TESTI20140360//metallopeptidase family M24
TESTI20177400//WD domain, G-beta repeat//WD domain, G-beta repeat//WD domain, G-beta repeat
THYMU10000830//FAD binding domain
THYMU10001760//Immunoglobulin domain
THYMU10002910//Adaptin N terminal region
THYMU10003590//PH domain//RhoGAP domain
THYMU10004590//HMG (high mobility group) box
THYMU10005580//Synaptobrevin
THYMU20002360//Pumilio-family RNA binding domains (aka PUM-HD, Pumilio homology domain)
THYMU20003690//Prokaryotic DNA topoisomerase//Protein of unknown function DUF122//Eukaryotic protein kinase domain
TRACH10000740//Immunoglobulin domain//Immunoglobulin domain//Immunoglobulin domain//Immunoglobulin domain
TRACH10001250//Immunoglobulin domain//Immunoglobulin domain//Immunoglobul in domain//Immunoglobulin domain
TRACH20000150//Fatty acid desaturase//Protein phosphatase 2C
TRACH20001850//Molluscan rhodopsin C-terminal tail
TRACH20002370//KRAB box//Zinc finger, C2H2 type//FYVE zinc finger//Zinc finger, C2H2 type//Zinc finger, C2H2 type//Zinc finger, C2H2 type//Zinc finger, C2H2 type//Zinc finger, C2H2 type//Zinc finger, C2H2 type
TRACH20002500//WD domain, G-beta repeat//WD domain, G-beta repeat//WD domain, G-beta repeat//WD domain, G-beta repeat//WD domain, G-beta repeat//WD domain, G-beta repeat//WD domain, G-beta repeat
TRACH20002890//PH domain//Src homology domain 2
TRACH20003930//RNA recognition motif. (a.k.a. RRM, RBD, or RNP domain)//RNA recognition motif. (a.k.a. RRM, RBD, or RNP domain)
TRACH20004110//Zinc finger, C2H2 type
TRACH20004200//Neurohypophysial hormones, C-terminal Domain//Keratin, high sulfur B2 protein
TRACH20004720//Aminotransferases class-II//Aminotransferases class-I
TRACH20004960//AMP-binding enzyme
TRACH20006650//LacY proton/sugar symporter//Sugar (and other) transporter
TRACH20006750//E1 Protein, N terminal domain//ATP synthase (E/31 kDa) subunit
TRACH20009260//short chain dehydrogenase
TRACH20012890//RNA recognition motif. (a.k.a. RRM, RBD, or RNP domain)
TRACH20016070//Adenylate cyclase
UMVEN10001220//Corticotropin-releasing factor family
UMVEN20001330//C2 domain//C2 domain//C2 domain
UTERU10001600//SCAN domain//Zinc finger, C2H2 type//Zinc finger, C2H2 type//Zinc finger, C2H2 type//Zinc finger, C2H2 type//Zinc finger, C2H2 type//Zinc finger, C2H2 type
UTERU10001920//Integrase core domain

EXAMPLE 6

Functional Categorization Based on the Full-Length Nucleotide Sequences

The functional prediction and categorization of the proteins encoded by the clones were carried out based on the result of homology search of the databases of GenBank, Swiss-Prot, UniGene and nr (see the Homology Search Result Data) for the full-length nucleotide sequences and the result of domain search of the amino acid sequences deduced from the full-length nucleotide sequences (see Example 5).

The clone predicted to belong to the category of secretory protein/membrane protein means a clone having hit data with some annotation, such as growth factor, cytokine, hormone, signal, transmembrane, membrane, extracellular matrix, receptor, G-protein coupled receptor, ionic channel, voltage-gated channel, calcium channel, cell adhesion, collagen, connective tissue, etc., suggesting that it is a secretory or membrane protein, or means a clone in which the presence of nucleotide sequence encoding a signal sequence or transmembrane domain was suggested by the results of PSORT and SOSUI analyses for deduced ORF.

The clone predicted to belong to the category of glycoprotein-related protein means a clone having hit data with some annotation, such as glycoprotein; suggesting that the clone encodes a glycoprotein-related protein.

The clone predicted to belong to the category of signal transduction-related protein means a clone having hit data with some annotation, such as serine/threonine-protein kinase, tyrosine-protein kinase, SH3 domain, SH2 domain, etc., suggesting that the clone encodes a signal transduction-related protein.

The clone predicted to belong to the category of transcription-related protein means a clone having hit data with some annotation, such as transcription regulation, zinc finger, homeobox, etc., suggesting that the clone encodes a transcription-related protein.

The clone predicted to belong to the category of disease-related protein means a clone having hit data with some annotation, such as disease mutation, syndrome, etc., suggesting that the clone encodes a disease-related protein, or means a clone whose full-length nucleotide sequence has hit data for Swiss-Prot, GeneBank, or UniGene, where the hit data corresponds to genes or proteins which have been deposited in the Online Mendelian Inheritance in Man (OMIM), which is the human gene and disease database.

The clone predicted to belong to the category of enzyme and/or metabolism-related protein means a clone having hit data with some annotation, such as metabolism, oxidoreductase, E. C. No. (Enzyme commission number), etc., suggesting that the clone encodes an enzyme and/or metabolism-related protein.

The clone predicted to belong to the category of cell division and/or cell proliferation-related protein means, a clone having hit data with some annotation, such as cell division, cell cycle, mitosis, chromosomal protein, cell growth, apoptosis, etc., suggesting that the clone encodes a cell division and/or cell proliferation-related protein.

The clone predicted to belong to the category of cytoskeleton-related protein means a clone having hit data with some annotation, such as structural protein, cytoskeleton, actin-binding, microtubles, etc., suggesting that the clone encodes a cytoskeleton-related protein.

The clone which is predicted to belong to the category of nuclear protein and/or RNA synthesis-related protein means a clone having hit data with some annotation, such as nuclear protein, RNA splicing, RNA processing, RNA helicase, polyadenylation, etc., suggesting that the clone encodes a nuclear protein, and/or RNA synthesis-related protein.

The clone predicted to belong to the category of protein synthesis and/or transport-related protein means a clone having hit data with some annotation, such as translation regulation, protein biosynthesis, amino-acid biosynthesis, ribosomal protein, protein transport, signal recognition particle, etc., suggesting that the clone encodes a protein synthesis and/or transport-related protein.

The clone predicted to belong to the category of cellular defense-related protein means a clone having hit data with some annotation, such as heat shock, DNA repair, DNA damage, etc., suggesting that the clone encodes a cellular defense-related protein.

The clone predicted to belong to the category of development and/or differentiation-related proteins means a clone having hit data with some annotation, such as developmental protein, etc., suggesting that the clone encodes a development and/or differentiation-related protein.

The clone predicted to belong to the category of DNA-binding and/or RNA-binding protein means a clone having hit data with some annotation, such as DNA-binding, RNA-binding, etc.

The clone predicted to belong to the category of ATP-binding and/or GTP-binding protein means a clone having hit data with some annotation, such as ATP-binding, GTP-binding, etc.

In this functional categorization, when a single clone corresponded to multiple categories of those shown above, the clone was assigned to the multiple categories. However, the function of a protein is not restricted to the functional category in this classification, and there is the possibility that other functions are newly assigned to the protein.

The clones predicted to belong to the category of secretory protein and/or membrane protein are the following 439 clones.

3NB6910000180, 3NB6910000850, 3NB6920000290, 3NB6920003300, 3NB6920005450, 3NB6920010020, ADRGL10000180, ADRGL10001600, ADRGL20003230, BGGI120010970, BNGH410000340, BNGH410001040, BNGH410001180, BNGH410001370, BNGH410001980, BRACE10000730, BRACE10001690, BRACE20002800, BRACE20007180, BRACE20010650, BRACE20011170, BRACE20011430, BRACE20013400, BRACE20013520, BRACE20014230, BRACE20014530, BRACE20014920, BRACE20015080, BRACE20018590, BRACE20022270, BRACE20024680, BRACE20026350, BRACE20026850, BRACE20030780, BRACE20031100, BRACE20034490, BRACE20071380, BRACE20071970, BRACE20072810, BRACE20074010, BRACE20074470, BRACE20075020, BRACE20075380, BRACE20076410, BRACE20076630, BRACE20076850, BRACE20077610, BRACE20077640, BRACE20077980, BRACE20078680, BRACE20079530, BRACE20084430, BRACE20086550, BRACE20089600, BRACE20091880, BRAWH10000010, BRAWH10000370, BRAWH10000940, BRAWH10001620, BRAWH10001800, BRAWH20001090, BRAWH20004430, BRAWH20006970, BRAWH20009840, BRAWH20011290, BRAWH20011410, BRAWH20011660, BRAWH20014380, BRAWH20014840, BRAWH20015030, BRAWH20036930, BRAWH20038320, BRAWH20040950, BRAWH20052250, BRAWH20059980, BRAWH20087060, BRAWH20092610, CD34C20000510, CTONG20013660, CTONG20015330, CTONG20028160, CTONG20037820, CTONG20047160, DFNES20003350, FCBBF10006180, FCBBF10006750, FCBBF20005910, FCBBF20007330, FCBBF20008150, FCBBF20009400, FCBBF20015380, FEBRA20003780, FEBRA20004040, FEBRA20004150, FEBRA20004520, FEBRA20004910, FEBRA20006560, FEBRA20006900, FEBRA20007330, FEBRA20008090, FEBRA20008800, FEBRA20010930, FEBRA20012270, FEBRA20012450, FEBRA20012940, FEBRA20013510, FEBRA20014870, FEBRA20014920, FEBRA20015840, FEBRA20020860, FEBRA20021910, FEBRA20025250, FEBRA20031550, FEBRA20037070, FEBRA20041100, FEBRA20041910, FEBRA20057780, FEBRA20063150, FEBRA20066670, FEBRA20067930, HCASM10000610, HCASM20002020, HEART20000990, HEART20004920, HHDPC20000950, HLUNG10000240, HLUNG10000370, HLUNG10001100, HLUNG20001160, HLUNG20001250, HLUNG20001420, HLUNG20001760, HLUNG20002550, HSYRA20003470, HSYRA20006290, HSYRA20008280, HSYRA20011030, HSYRA20013320, HSYRA20014200, HSYRA20015800, IMR3210000440, IMR3210001580, IMR3210002660, IMR3220007750, IMR3220008590, IMR3220009840, IMR3220014350, KIDNE10000080, KIDNE10001040, KIDNE10001430, KIDNE20000700, KIDNE20000850, KIDNE20001670, KIDNE20003150, KIDNE20003300, KIDNE20003490, KIDNE20004220, KIDNE20005170, KIDNE20005190, KIDNE20033050, KIDNE20033570, KIDNE20039410, KIDNE20042620, KIDNE20042950, KIDNE20044110, KIDNE20048280, KIDNE20049810, KIDNE20054000, KIDNE20054770, KIDNE20060530, KIDNE20060620, KIDNE20063530, KIDNE20063760, KIDNE20066520, KIDNE20067600,

KIDNE20071860, KIDNE20073520, KIDNE20074220, KIDNE20075690, LIVER10000580, LIVER10000670, LIVER10001040, LIVER10001110, LIVER10001750, LIVER10005420, LIVER20004160, MAMGL10000320, MAMGL10001840, MESAN10000350, MESAN10001470, MESAN10001800, MESAN20001490, NB9N420000420, NHNPC20002060, NT2NE10000230, NT2NE10000830, NT2NE10001630, NT2NE20003270, NT2NE20003920, NT2NE20004550, NT2NE20004700, NT2NE20005500, NT2NE20012470, NT2NE20014350, NT2NE20016260, NT2NE20034080, NT2NE20047160, NT2NE20055170, NT2NE20057200, NT2RI20005970, NT2RI20009740, NT2RI20010100, NT2RI20014490, NT2RI20015400, NT2RI20015950, NT2RI20016570, NT2RI20018660, NT2RI20020220, NT2RI20021520, NT2RI20022430, NT2RI20022520, NT2RI20025300, NT2RI20030110, NT2RI20030510, NT2RI20031540, NT2RI20033010, NT2RI20033830, NT2RI20036780, NT2RI20042840, NT2RI20044420, NT2RI20049850, NT2RI20050870, NT2RI20051500, NT2RI20066820, NT2RI20068250, NT2RI20070480, NT2RI20070840, NT2RI20073030, NT2RI20074980, NT2RI20077540, NT2RI20078270, NT2RI20080500, NT2RI20081880, NT2RI20084810, NT2RI20085980, NT2RI20089420, NT2RI20092890, NT2RI20094060, NT2RP60000320, NT2RP60000390, NT2RP60001090, NT2RP70000690, NT2RP70002380, NT2RP70002590, NT2RP70003640, NT2RP70011660, NT2RP70015910, NT2RP70021510, NT2RP70023760, NT2RP70023790, NT2RP70026190, NT2RP70029820, NT2RP70040800, NT2RP70043730, NT2RP70047900, NT2RP70049250, NT2RP70055200, NT2RP70064080, NT2RP70071540, NT2RP70071770, NT2RP70073810, NT2RP70074220, NT2RP70075040, NT2RP70076170, NT2RP70079250, NT2RP70079750, NT2RP70081330, NT2RP70081370, NT2RP70083150, NT2RP70085500, NT2RP70090120, NT2RP70091490, NT2RP70091680, NT2RP70092360, NT2RP70093220, NT2RP70093730, NT2RP70094290, NT2RP70094810, NT2RP70094980, NT2RP70095070, NTONG10000980, NTONG10002140, NTONG10002570, NTONG20002650, NTONG20004920, NTONG20008000, NTONG20012220, OCBBF10000420, OCBBF20002310, OCBBF20009980, OCBBF20012100, PANCR10000210, PLACE50000670, PLACE50000680, PLACE50001050, PLACE50001130, PLACE60012810, PLACE60018860, PLACE60020160, PLACE60020840, PLACE60026990, PLACE60037050, PLACE60037450, PLACE60043960, PLACE60044540, PLACE60047380, PLACE60049930, PLACE60050290, PROST10002200, PROST10002720, PROST10005260, PROST10005360, PROST20000360, PROST20026820, PROST20029600, PROST20032320, PROST20033020, PROST20039220, PROST20044160, PROST20051430, PROST20054260, PROST20058800, PROST20059190, PROST20059430, PROST20069880, PROST20072370, PROST20073890, PUAEN10000570, PUAEN10003220, SALGL10001570, SKMUS20007740, SKNMC10000190, SKNMC10000290, SKNMC10002290, SKNMC10002510, SKNMC20011130, SKNMC20015030, SMINT10000160, SMINT10000420, SMINT10000570, SMINT10001180, SMINT20000180, SMINT20002770, SPLEN10000910, SPLEN20001340, SPLEN20002430, SPLEN20002700, SPLEN20003100, SPLEN20004960, STOMA10000520, STOMA10001170, STOMA20000320, STOMA20002570, SYNOV20001770, SYNOV20016480, TESTI10000420, TESTI10000960, TESTI10001270, TESTI10001380, TESTI20001770, TESTI20006000, TESTI20007620, TESTI20008830, TESTI20009090, TESTI20009700, TESTI20011340, TESTI20012370, TESTI20013520, TESTI20014200, TESTI20016210, TESTI20016710, TESTI20018520, TESTI20018620, TESTI20020020, TESTI20020810, TESTI20022510, TESTI20024230, TESTI20024650, TESTI20024670, TESTI20025800, TESTI20026320, TESTI20026980, TESTI20027000, TESTI20027070, TESTI20028660, TESTI20030370, TESTI20031930, TESTI20034190, TESTI20036490, TESTI20039980, TESTI20042870, TESTI20047120, TESTI20049940, TESTI20056900, TESTI20057420, TESTI20058600, TESTI20067740, TESTI20069780, TESTI20074800, TESTI20077490, TESTI20079510, TESTI20080200, TESTI20081440, TESTI20087740, TESTI20088470, TESTI20136910, THYMU10000830, THYMU10001760, THYMU10003290, THYMU10003820, THYMU10005580, TRACH10000630, TRACH10001000, TRACH10001400, TRACH20001850, TRACH20001960, TRACH20004200, TRACH20004960, TRACH20006650, TRACH20007670, TRACH20008980, TRACH20015920, UMVEN20001330, UTERU10000770, UTERU10000960, UTERU10001920, UTERU20000470, UTERU20003930, UTERU20004850

The clones predicted to belong to the category of glycoprotein-related protein are the following 87 clones.

BNGH410000340, BNGH410001180, BRACE20014920, BRACE20015080, BRACE20018590, BRACE20024680, BRACE20026350, BRACE20031100, BRACE20074470, BRAWH10000370, BRAWH20001090, BRAWH20011660, BRAWH20014840, BRAWH20059980, CD34C20000510, CTONG20013660, CTONG20028160, CTONG20037820, FCBBF20007330, FEBRA20007330, FEBRA20008800, FEBRA20014920, FEBRA20015840, FEBRA20057780, HEART20005060, HLUNG10001100, HLUNG20002550, HSYRA20013320, IMR3210002660, IMR3220007750, IMR3220013320, KIDNE20044110, KIDNE20063760, KIDNE20067600, KIDNE20073520, LIVER20000370, MESAN10000350, NT2NE10000830, NT2NE10001850, NT2NE20003270, NT2NE20016260, NT2RI20018660, NT2RI20025300, NT2RI20036780, NT2RI20077540, NT2RI20080500, NT2RI20085980, NT2RI20089420, NT2RI20092890, NT2RP70000690, NT2RP70004770, NT2RP70055200, NT2RP70081370, NT2RP70083150, NT2RP70091490, NT2RP70092360, NT2RP70094980, NTONG10002140, OCBBF20002310, OCBBF20002770, PLACE50000680, PLACE50001130, PLACE60018860, PLACE60044540, PROST20018230, PROST20032320, PROST20073890, SALGL10001570, SKNMC20015030, SMINT10000160, SMINT20002770, SPLEN20001340, TESTI10001270, TESTI10001380, TESTI20001770, TESTI20024230, TESTI20027070, TESTI20036490, TESTI20039980, TESTI20056900, TESTI20057420, TESTI20079510, THYMU10001760, TRACH10000740, TRACH10001250, TRACH20004200, UTERU20000470

The clones predicted to belong to the category of signal transduction-related protein are the following 46 clones.

ADRGL20000740, ASTRO10000180, BRACE20005770, BRACE20022020, BRACE20027360,

BRACE20027920, BRAWH20006860, CTONG20005890, FEBRA20000350, HHDPC20000550, IMR3220003020, KIDNE20033730, KIDNE20040840, KIDNE20053360, KIDNE20062990, NT2RI20033440, NT2RI20058110, NT2RI20062100, NT2RI20073840, NT2RP70006240, NT2RP70043960, NT2RP70046870, NT2RP70061880, NT2RP70072520, NT2RP70081440, NT2RP70093700, NTONG10001820, PEBLM20004790, PLACE60026680, PROST20033400, PROST20043320, SKMUS10000220, SKMUS20016680, SPLEN20003570, TESTI20001540, TESTI20005910, TESTI20022560, TESTI20024980, TESTI20029120, TESTI20034980, TESTI20049820, TESTI20055840, THYMU10003590, THYMU20003690, TRACH20002500, TRACH20002890,

The clones predicted to belong to the category of transcription-related protein are the following 140 clones.
3NB6920010220, 3NB6920015110, 3NB6920015570, ADRGL10000650, BGGI120006840, BGGI120006930, BGGI120017140, BNGH410000800, BNGH420005320, BRACE10000930, BRACE20014550, BRACE20018550, BRACE20020910, BRACE20024090, BRACE20071740, BRAWH10000020, BRAWH10001640, BRAWH10001680, BRAWH20006330, BRAWH20009010, CTONG20025580, CTONG20028200, FCBBF10005980, FCBBF20000940, FCBBF20009510, FCBBF50002610, FEBRA20003970, FEBRA20003990, FEBRA20004540, FEBRA20009720, FEBRA20011460, FEBRA20017150, FEBRA20050140, FEBRA20064760, FEBRA20067360, FEBRA20069420, FEBRA20072800, HLUNG10000760, HLUNG20000680, HSYRA10001370, HSYRA20016310, IMR3210002420, IMR3220007420, KIDNE20000510, KIDNE20039940, KIDNE20061490, KIDNE20078110, NESOP10000870, NHNPC10001240, NHNPC20002120, NT2NE20002590, NT2NE20008090, NT2RI20003410, NT2RI20004120, NT2RI20004210, NT2RI20010830, NT2RI20018460, NT2RI20025410, NT2RI20025850, NT2RI20060710, NT2RI20067350, NT2RI20071330, NT2RI20074390, NT2RI20078790, NT2RI20087140, NT2RI20090650, NT2RI20092150, NT2RP60001000, NT2RP60001270, NT2RP70002710, NT2RP70008120, NT2-RP70018560, NT2RP70024500, NT2RP70032030, NT2RP70036290, NT2RP70042040, NT2RP70045410, NT2RP70046560, NT2RP70055130, NT2RP70061620, NT2RP70062960, NT2RP70064900, NT2RP70069860, NT2RP70075370, NT2RP70085570, NT2RP70087200, NT2RP70090190, NTONG20003340, NTONG20003630, NTONG20015500, OCBBF20011010, OCBBF20011240, OCBBF20015860, PEBLM20002480, PEBLM20002700, PEBLM20003080, PEBLM20003950, PLACE60002050, PLACE60005550, PLACE60021510, PLACE60030380, PROST20018230, PROST20031170, PROST20073170, PUAEN10001610, SALGL10000650, SKMUS10000640, SKMUS20014920, SKNMC20000650, SKNMC20002240, SKNMC20003560, SMINT10001000, SMINT20005450, SPLEN20000200, SPLEN20000720, SYNOV20010140, SYNOV20013740, SYNOV20014510, TESTI10000550, TESTI20001200, TESTI20007070, TESTI20010490, TESTI20015560, TESTI20018150, TESTI20018790, TESTI20021490, TESTI20026760, TESTI20027890, TESTI20030710, TESTI20034130, TESTI20042290, TESTI20053960, TESTI20074640, TESTI20074660, TESTI20078640, THYMU10004590, TRACH20000790, TRACH20002370, TRACH20009440, UTERU10001600

The clones predicted to belong to the category of disease-related protein are the following 219 clones. Further, hit data of all the clones for Swiss-Prot, or GenBank, UniGene, or nr corresponded to genes or proteins which had been deposited in the Online Mendelian Inheritance' in Man (OMIM), which is the human gene and disease database, (the OMIM Number is shown in the parenthesis after the Clone Name).
ADRGL10000020 (605332), ADRGL10001600 (201910), ADRGL20000740 (300118), ASTRO20004170 (605937), BGGI120006840 (604480), BGGI120010970 (602346), BGGI120017140 (194631), BNGH410001770 (146690), BNGH420005320 (601260), BRACE10001870 (157132), BRACE20006980 (106410), BRACE20007180 (114160), BRACE20014550 (140580), BRACE20018550 (109560), BRACE20018590 (602644), BRACE20027550 (179715), BRACE20027720 (138760), BRACE20076850 (605209), BRACE20086550 (603540), BRAWH10000020 (605678), BRAWH10001640 (606043), BRAWH20001770 (138450), BRAWH20005030 (179715), BRAWH20005220 (603747), BRAWH20006330 (194500), BRAWH20006860 (602958), BRAWH20009840 (601258), BRAWH20011660 (230500;230600;230650;253010), CD34C20000510 (600031), CTONG20005890 (603583), CTONG20019110 (603486), CTONG20024180 (602895), CTONG20025580 (601856), CTONG20037820 (602729), CTONG20055530 (106410), FCBBF20000940 (601408), FCBBF20009510 (194531), FCBBF40002820 (130410), FEBRA20001050 (600025), FEBRA20003990 (601781), FEBRA20004150 (126650;214700), FEBRA20004540 (194558), FEBRA20009720 (602277), FEBRA20010930 (603878), FEBRA20011460 (603900), FEBRA20050790 (176879), FEBRA20057880 (604362), FEBRA20064760 (602277), FEBRA20067930 (602921), FEBRA20070170 (606098), FEBRA20075510 (179513), FEBRA20075660 (179715), HCASM20002140 (123834), HEART20004480 (191045;115195), HLUNG10001050 (310400), HLUNG20000680 (300024), HSYRA10001370 (602277), HSYRA20006400 (601278), HSYRA20013320 (146732), HSYRA20016310 (604080), IMR3210000440 (601890), IMR3220007910 (313440), KIDNE10001040 (603217), KIDNE20003150 (602417), KIDNE20033730 (605216), KIDNE20042950 (120160), KIDNE20044110 (605239), KIDNE20050420 (214500), KIDNE20059080 (604276), KIDNE20063760 (231950), KIDNE20078110 (603430), LIVER10002300 (161015), LIVER10004330 (603197), LIVER20000330 (191161), LIVER20000370 (138670), MAMGL10001780 (603403), MESAN10001800 (606048), MESAN20002910 (142810), MESAN20005010 (602769), NB9N410001350 (179508), NHNPC10000840 (604819), NHNPC20002120 (194558), NT2NE10000730 (601905), NT2NE20002990 (147625), NT2NE20003690 (232000), NT2NE20005170 (603330), NT2NE20005360 (150370), NT2NE20006580 (605969), NT2NE20008090 (603899), NT2NE20013720 (180480), NT2NE20016340 (602184), NT2NE20055170 (128100), NT2RI20004120 (600140), NT2RI20004210 (314997), NT2RI20010910 (601940), NT2RI20014500 (190370), NT2RI20020410 (168730;180990), NT2RI20029580 (605689), NT2RI20031540 (300061), NT2RI20033440 (601014), NT2RI20041900 (179715), NT2RI20056470 (123940), NT2RI20057230 (601940), NT2RI20067030 (603577), NT2RI20070960 (311030), NT2RI20074980 (603105), NT2RI20077540 (300112), NT2RI20080500 (142461), NT2RI20083960 (605612), NT2RI20084810 (603099), NT2RI20092150 (600834), NT2RI20092890 (603104), NT2RP60000350 (605612), NT2RP60001000 (314995), NT2RP60001230 (600025), NT2RP70000690 (158340;113720), NT2RP70004250 (160776), NT2RP70028750 (179838), NT2RP70029060 (140571), NT2RP70032030 (602277), NT2RP70036290 (600005;209920), NT2RP70042600 (160776), NT2RP70046560 (602410), NT2RP70049250 (601703), NT2RP70055020 (604581), NT2RP70062960 (133540), NT2RP70063040 (604061), NT2RP70065270 (300111), NT2RP70069860 (602277), NT2RP70071770 (603046), NT2RP70073810 (601439), NT2RP70074220 (313440), NT2RP70075370 (109092), NT2RP70079250 (602346), NT2RP70081440 (601335), NT2RP70090120 (602727), NT2RP70090190 (194558), NT2RP70093220 (300008;300009;310468), NT2RP70094980 (135820), NTONG10002460 (600856), NTONG20003630 (600140), NTONG20015500 (604077), OCBBF10001180 (191161), OCBBF20008240 (187790), PEBLM10000340 (133450), PEBLM20002480 (300024), PEBLM20003080 (604077), PEBLM20003950 (600834), PLACE50000800 (601797), PLACE60002050 (600013), PLACE60003790 (603403), PLACE60014430 (603707), PROST10001670 (313440), PROST10005360 (602346), PROST20002730 (601985;188550), PROST20032320 (253220), PROST20033400 (300203), PROST20062600 (601940), PROST20072890 (191161), PROST20073890 (192240), PROST20085160 (191030;164970), SALGL10001570 (603743), SKMUS10000140 (191340), SKMUS10001180 (601402), SKMUS10001290 (604055), SKMUS20000740 (605196), SKMUS20003900 (604850), SKMUS20007240 (604300), SKMUS20016340 (163906), SKNMC10002510 (605452), SKNMC20000650 (604078), SKNMC20003220 (117140), SMINT10000420 (601615), SMINT10000570 (604814), SMINT10001000 (603851), SMINT10001030 (605759), SMINT20004000 (601278), SPLEN10001430 (163905), SPLEN20001970 (601940), STOMA20000880 (147220), STOMA20003960 (300111), SYNOV20013740 (604076), SYNOV20014510 (600661), SYNOV20016480 (131222;603041), TESTI10001270 (601313;173900), TESTI10001310 (186982), TESTI20001200 (194510), TESTI20001770 (146650), TESTI20002530 (605440), TESTI20006000 (179838), TESTI20006990 (602591), TESTI20007620 (126650;214700), TESTI20008830 (160794), TESTI20011800 (190370), TESTI20012690 (109720), TESTI20015120 (604700), TESTI20018520 (602346), TESTI20018790 (300024), TESTI20021490 (604073), TESTI20025160 (300097), TESTI20027070 (173335), TESTI20027290 (300127), TESTI20029120 (600855), TESTI20033250 (168730), TESTI20049820 (176894), TESTI20053960 (604074), TESTI20068660 (603395), TESTI20071830 (605769), TESTI20074640 (603899), TESTI20079510 (116930), TESTI20086570 (300153), TESTI20140360 (170100), THYMU10000830 (600857), THYMU10001760 (116930), THYMU10003590 (602857), THYMU10004910 (604908), TRACH20002370 (602277), UTERU10000960 (603931), UTERU20000470 (602070)

The clones predicted to belong to the category of enzyme and/or metabolism-related protein are the following 168 clones.

3NB6920002810, ADRGL10001600, ADRGL10001650, BGGI120005330, BNGH410000340, BNGH410001770, BRACE10000420, BRACE20015080, BRACE20022020, BRACE20024680, BRACE20026850, BRACE20027360, BRACE20027720, BRACE20027920, BRACE20071380, BRACE20084430, BRAWH20001770, BRAWH20006510, BRAWH20006860, BRAWH20009840, BRAWH20011660, BRAWH20014180, BRAWH20014840, BRAWH20036890, BRAWH20059980, BRAWH20069890, BRAWH20089560, CTONG20013660, CTONG20019110, DFNES20002120, FCBBF20007330, FCBBF20015380, FEBRA20000350, FEBRA20001290, FEBRA20003110, FEBRA20024420, FEBRA20041100, FEBRA20045920, FEBRA20050790, FEBRA20052160, FEBRA20062700, FEBRA20063150, HEART20000350, HHDPC20000550, HHDPC20004550, HLUNG10001050, HLUNG20002550, HSYRA10001680, HSYRA20005100, HSYRA20015740, IMR3220008380, IMR3220009190, IMR3220012180, IMR3220013170, KIDNE20000410, KIDNE20003490, KIDNE20004220, KIDNE20005130, KIDNE20033050, KIDNE20040840, KIDNE20046810, KIDNE20056290, KIDNE20060530, KIDNE20063760, KIDNE20068800, KIDNE20073280, KIDNE20073520, KIDNE20078100, LIVER10000670, LIVER10002300, MAMGL10001780, MESAN20002910, MESAN20005010, NT2NE10000730, NT2NE10001850, NT2NE20002140, NT2NE20003270, NT2NE20003690, NT2NE20005860, NT2NE20013720, NT2NE20016340, NT2NE20016660, NT2RI10000480, NT2RI20010100, NT2RI20015400, NT2RI20020220, NT2RI20025300, NT2RI20033010, NT2RI20036780, NT2RI20037510, NT2RI20051500, NT2RI20068550, NT2RI20073840, NT2RI20074980, NT2RI20084810, NT2RI20087910, NT2RP70004770, NT2RP70006240, NT2RP70011660, NT2RP70026190, NT2RP70062960, NT2RP70072520, NT2RP70076100, NT2RP70081440, NT2RP70084060, NT2RP70085570, NT2RP70093700, NTONG10001820, OCBBF20008240, OCBBF20012100, OCBBF20014080, OCBBF20014940, PANCR10000210, PEBLM20004790, PLACE50001050, PLACE50001130, PLACE60003790, PLACE60012810, PLACE60018860, PLACE60044540, PROST20031170, PROST20032320, PROST20033400, PROST20051210, PROST20064500, SKMUS10001290, SKMUS10001770, SKMUS20000740, SKMUS20007240, SKMUS20008630, SKMUS20009330, SKMUS20011290, SKNSH10001740, SKNSH20003470, SMINT10000160, SPLEN20001340, STOMA10001860, STOMA20001210, STOMA20004820, SYNOV20016480, TESTI10000700, TESTI10001380, TESTI20001540, TESTI20005910, TESTI20012690, TESTI20018270, TESTI20022560, TESTI20027070, TESTI20029120, TESTI20034190, TESTI20034980, TESTI20040000, TESTI20042070, TESTI20042950, TESTI20047120, TESTI20049820, TESTI20138320, TESTI20140360, TESTI30000020, THYMU10000830, THYMU10004910, THYMU20003170, THYMU20003690, TRACH20000150, TRACH20004720, TRACH20004970, TRACH20009260, UTERU10000960

The clones predicted to belong to the category of cell division and/or cell proliferation-related protein are the following 23 clones.

BGGI120001610, BRACE20027550, BRACE20076850, BRAWH20005030, BRAWH20005220, FEBRA20075660, HCASM20002140, HLUNG10000640, IMR3220009730, NT2NE20003840, NT2RI20006850, NT2RI20041900, NT2RI20058110, NTONG10002460, NTONG20008780, SKMUS20016340, SKNMC20003220, SPLEN10001430, TESTI10001680, TESTI20001840, TEST120021050, TESTI20035120, TESTI20057310

The clones predicted to belong to the category of cytoskeleton-related protein are the following 60 clones.

ADRGL10000020, BRACE20006980, BRACE20008850, BRACE20027960, BRACE20074470, BRACE20076630, BRACE20078820, BRACE20093070, BRAWH20000480, BRAWH20066220, CTONG20019550, CTONG20028160, CTONG20055530, DFNES20002680, FCBBF20005910, FEBRA20007720, FEBRA20008810, FEBRA20034290, FEBRA20043290, FEBRA20072000, HEART20004480, HEART20005200, HLUNG10001100, HSYRA20006050, IMR3220007910, KIDNE20040840, KIDNE20052960, NT2RI20014090, NT2RI20032220, NT2RI20058510, NT2RI20090660, NT2RP70000690, NT2RP70004250, NT2RP70028750, NT2RP70042600, NT2RP70049250, NT2RP70074220, NTONG20009660, OCBBF20011760, OCBBF20015280, PEBLM10000680, PROST10001670, PROST20033380, TESTI10000420, TESTI10000510, TESTI20003560, TESTI20004350, TESTI20006000, TESTI20006990, TESTI20008490, TESTI20008830, TESTI20011410, TESTI20015110, TESTI20016610, TESTI20020570, TESTI20024230, TESTI20031090, TESTI20031170, TESTI20039140, TESTI20078720

The clones predicted to belong to the category of nuclear protein and/or RNA synthesis-related protein are the following 59 clones.

3NB6920002810, 3NB6920015280, BGGI120005440, BRACE10001150, BRACE20024780, BRACE20027550, BRAWH20005030, BRAWH20014180, BRAWH20069890, CTONG20024180, FEBRA20001290, FEBRA20075660, HEART20003090, HLUNG10000640, HSYRA10001680, HSYRA20005100, IMR3220008630, IMR3220012180, MAMGL10001780, NT2NE10001850, NT2NE20002140, NT2NE20003840, NT2NE20016660, NT2NE20054410, NT2RI20002820, NT2RI20006850, NT2RI20010910, NT2RI20025540, NT2RI20041900, NT2RI20053350, NT2RI20057230, NT2RI20060720, NT2RI20067030, NT2RI20068550, NT2RI20078840, NT2RI20087490, NT2RP70004770, NT2RP70013060, NT2RP70076430, NTONG20008780, PEBLM10000340, PLACE50000580, PLACE60003790, PROST20001760, PROST20062600, SKMUS10000220, SKMUS20016340, SKNMC20003220, SPLEN10001430, SPLEN20001970, TESTI10001680, TESTI20002530, TESTI20007840, TESTI20021050, TESTI20029120, TESTI20035120, TESTI20057310, TRACH20003930, TRACH20012890

The clones predicted to belong to the category of protein synthesis and/or transport-related protein are the following 24 clones.

BRACE20078680, FEBRA20075510, IMR3220008380, KIDNE20005190, KIDNE20050420, MESAN20002910, NB9N410001350, NT2NE20005360, NT2RI20032050, NT2RI20032220, NT2RP70000760, NT2RP70076430, NT2RP70093940, OCBBF20008240, PLACE50000580, PROST20000530, SKMUS20000740, SKMUS20008630, TESTI20007840, TESTI20015120, TESTI20018690, TESTI20078720, THYMU10005580, UMVEN20001330

The clones predicted to belong to the category of cellular defense-related protein are the following 6 clones.

BRACE20014550, NT2RI20037510, NT2RI20053350, NT2RP70029060, NT2RP70062960, PLACE50001700

The clones predicted to belong to the category of development and/or differentiation-related protein are the following 19 clones.

BGGI120006930, CTONG20028200, FCBBF50002610, FEBRA20014920, FEBRA20017150, FEBRA20060920, MAMGL10001820, NESOP10000870, NHNPC10001240, NT2RI20078790, NT2RP70008120, NT2RP70018560, NT2RP70045410, OCBBF20002770, SALGL10000650, SMINT10001000, TESTI10000550, TESTI20026760, TESTI20078140

The clones predicted to belong to the category of DNA-binding and/or RNA-binding protein are the following 158 clones.

3NB6920002810, 3NB6920010220, 3NB6920015110, 3NB6920015570, ADRGL10000650, BGGI120006840, BGGI120006930, BNGH410000800, BNGH420005320, BRACE20014550, BRACE20020910, BRACE20024090, BRACE20024780, BRACE20071740, BRAWH10001640, BRAWH10001680, BRAWH20000340, BRAWH20006330, BRAWH20009010, BRAWH20014180, BRAWH20069890, CTONG20025580, CTONG20028200, D30ST20001840, FCBBF10005980, FCBBF20009510, FCBBF50002610, FEBRA20003970, FEBRA20003990, FEBRA20004540, FEBRA20008560, FEBRA20009720, FEBRA20017150, FEBRA20017900, FEBRA20050140, FEBRA20064760, FEBRA20067360, FEBRA20069420, FEBRA20072800, HEART20003090, HLUNG10000760, HSYRA10001370, HSYRA20016310, IMR3210002420, IMR3220007420, IMR3220008630, KIDNE20000510, KIDNE20039940, KIDNE20061490, KIDNE20078110, NESOP10000870, NHNPC10000840, NHNPC10001240, NHNPC20002120, NT2NE20002590, NT2NE20003840, NT2NE20008090, NT2NE20016660, NT2NE20054410, NT2RI20003410, NT2RI20004210, NT2RI20006850, NT2RI20010830, NT2RI20010910, NT2RI20025410, NT2RI20025850, NT2RI20057230, NT2RI20060710, NT2RI20067350, NT2RI20071330, NT2RI20074390, NT2RI20078790, NT2RI20078840, NT2RI20087140, NT2RI20087490, NT2RI20090650, NT2RP60001000, NT2RP60001270, NT2RP70002710, NT2RP70008120, NT2RP70013060, NT2RP70018560, NT2RP70024500, NT2RP70032030, NT2RP70042040, NT2RP70045410, NT2RP70046560, NT2RP70055130, NT2RP70061620, NT2RP70062960, NT2RP70064900, NT2RP70069860, NT2RP70075370, NT2RP70081670, NT2RP70085570, NT2RP70087200, NT2RP70090190, NTONG20003340, NTONG20008780, NTONG20015500, OCBBF20011010, OCBBF20015860, PEBLM10000340, PEBLM20001120, PEBLM20002700, PEBLM20003080, PLACE60002050, PLACE60005550, PLACE60021510, PLACE60030380, PROST20001760, PROST20003250, PROST20018230, PROST20031170, PROST20062600, PROST20073170,

SALGL10000650, SKMUS10000640, SKMUS20014920, SKMUS20016340, SKNMC20000650, SKNMC20000240, SKNMC20003220, SKNMC20003560, SMINT10001000, SMINT20005450, SPLEN10001430, SPLEN20000200, SPLEN20000720, SPLEN20001970, SYNOV20010140, SYNOV20013740, SYNOV20014510, TESTI10000550, TESTI20001200, TESTI20007070, TESTI20010490, TESTI20013450, TESTI20015560, TESTI20018150, TESTI20021050, TESTI20021490, TESTI20026760, TESTI20027890, TESTI20030710, TESTI20033270, TESTI20034130, TESTI20035120, TESTI20053960, TESTI20074640, TESTI20074660, TESTI20078640, THYMU10004590, TRACH20000790, TRACH20002370, TRACH20009440, TRACH20012890, UTERU10001600

The clones predicted to belong to the category of ATP binding and/or GTP-binding protein are the following 63 clones.

3NB6920002810, BNGH410000390, BRACE20022020, BRACE20028120, BRACE20071380, BRAWH20000480, BRAWH20006860, BRAWH20066220, CTONG20013200, DFNES20002680, FEBRA20043290, FEBRA20052160, FEBRA20072000, FEBRA20075510, HHDPC20000550, HLUNG20001160, HSYRA10001680, HSYRA20005100, HSYRA20006050, KIDNE20040840, MAMGL10001780, MESAN20002910, NB9N410001350, NT2NE20003690, NT2NE20005170, NT2NE20016660, NT2NE20055170, NT2RI20068550, NT2RI20073840, NT2RP70004250, NT2RP70011660, NT2RP70029060, NT2RP70036290, NT2RP70042600, NT2RP70046870, NT2RP70062960, NT2RP70081370, NT2RP70081440, NT2RP70093700, OCBBF20008240, OCBBF20015280, PEBLM20004790, PLACE50001700, PLACE60003790, PROST20018990, PROST20033400, SKMUS20008630, SMINT10000420, TESTI20001540, TESTI20003560, TESTI20005910, TESTI20006950, TESTI20006990, TESTI20008490, TESTI20015110, TESTI20016610, TESTI20022560, TESTI20029120, TESTI20034980, TESTI20042290, TESTI20047120, TESTI20049820, TESTI20057310

Among the clones other than the ones shown above, NTONG10001300 is a clone which was predicted to highly possibly belong to the category of secretory protein and/or membrane protein based on the result of domain search by Pfam.

FEBRA20017060, NT2RI20066790, SMINT10000710

The three clones shown above are clones which were predicted to highly possibly belong to the category of glycoprotein-related protein based on the result of domain search by Pfam.

BRACE20080970, BRACE20092120, BRAWH10001300, FEBRA20019890, KIDNE20031850, KIDNE20060140, MESAN20000920, NB9N410000470, NT2RI20071480, NT2RI20078910, NT2RP70088550, NTONG20016120, OCBBF10000910, PROST20094830, SKNSH10003010, SPLEN20002670, TESTI20031960, TESTI20036250, TESTI20037810, TESTI20083870, TESTI20177400

The 21 clones shown above are clones which were predicted to highly possibly belong to the category of signal transduction-related protein based on the result of domain search by Pfam.

3NB6920009120, 3NB6920014710, BRACE10001660, BRACE20083850, BRAWH20004760, BRAWH20012030, CTONG20011390, CTONG20018200, FEBRA20007870, FEBRA20043250, HHDPC20003150, NT2RI10000270, NT2RI20036950, NT2RI20053680, NT2RI20072540, NT2RI20083360, NT2RP70030550, OCBBF20013070, OCBBF20015270, PLACE60046630, PROST10003430, PROST20067370, SKMUS10001040, SKNMC20015960, TESTI20030050, TESTI20033540, TESTI20035890, TESTI20068720, TRACH20004110

The 29 clones shown above are clones which were predicted to highly possibly belong to the category of transcription-related protein based on the result of domain search by Pfam.

BNGH410001900, BRACE20080970, BRACE20092120, BRAWH20093600, FEBRA20003770, FEBRA20024290, HLUNG10000990, KIDNE20004030, MESAN20000920, NB9N420001040, NT2NE10000140, NT2NE20001740, NT2RI20050610, NT2RI20055640, NT2RI20072540, NT2RI20074690, NT2RP60000860, NT2RP70036470, NT2RP70036800, NT2RP70072210, NT2RP70074060, NT2RP70084870, NTONG10001300, NTONG10002640, NTONG20016120, OCBBF10000910, OCBBF10001190, OCBBF20007190, SKMUS20001170, SKMUS20016620, SKNMC20000970, SKNMC20015960, SYNOV10001280, TESTI20002380, TESTI20006270, TESTI20013300, TESTI20031520, TESTI20036250, TESTI20037810, TESTI20064830, TESTI20083870, TRACH20006750, TRACH20016070

The 43 clones shown above are clones which were predicted to highly possibly belong to the category of enzyme and/or metabolism-related protein based on the result of domain search by Pfam.

NT2RI20064120

The clone shown above is a clone which were predicted to highly possibly belong to the category of cell division and/or cell proliferation-related protein based on the result of domain search by Pfam.

BRACE20083800, KIDNE20004970

The two clones shown above are clones which were predicted to highly possibly belong to the category of cytoskeleton-related protein based on the result of domain search by Pfam.

3NB6920009120, 3NB6920014710, BRACE10001660, BRACE20083850, BRAWH20004760, BRAWH20012030, BRAWH20064500, CTONG20011390, CTONG20018200, FEBRA20007870, FEBRA20043250, HCASM20003070, HHDPC20003150, NT2RI10000270, NT2RI20036950, NT2RI20053680, NT2RI20072540, NT2RI20083360, NT2RP70012310, NT2RP70030550, NT2RP70036470, OCBBF20013070, OCBBF20015270, PLACE60046630, PROST10003430, PROST20067370, SKMUS10001040, SKNMC20000970, SKNMC20015960, TESTI20030050, TESTI20032280, TESTI20033540, TESTI20035890, TESTI20068720, TRACH20004110

The 34 clones shown above are clones which were predicted to highly possibly belong to the category of DNA-binding and/or RNA-binding protein based on the result of domain search by Pfam.

NT2RI20064120

The clone shown above is a clone which was predicted to highly possibly belong to the category of ATP-binding and/or GTP-binding protein based on the result of domain search by Pfam.

The 178 clones shown below are clones which were unassignable to any of the above-mentioned categories, but have been predicted to have some functions based on homology search for their full-length nucleotide sequences and motif search in their deduced ORFs. Clone Name, Definition in the result of homology search or Motif Name in the motif search, demarcated by a double slash mark (//), are shown below.

3NB6910001160//STEROIDOGENIC ACUTE REGULATORY PROTEIN PRECURSOR.
3NB6910001290//KRAB box
3NB6910001730//RI01/ZK632. 3/MJ0444 family
3NB6920014330//Domain of unknown function
ASTR020000950//SNAP-25 family
BNGH410000030//*R. norvegicus* trg mRNA.
BNGH410000290//SPRY domain
BRACE20005250//DRR1 PROTEIN (TU3A PROTEIN).
BRACE20005650//ATP synthase ab C terminal
BRACE20013750//Hepatitis C virus non-structural protein NS4a
BRACE20014770//HUNTINGTIN ASSOCIATED PROTEIN 1 (HAP1).
BRACE20016730//*Mus musculus* mdgI-1 mRNA, complete cds.
BRACE20017370//*P.vivax* pval gene.
BRACE20019440//Protein of unknown function DUF82
BRACE20024310//P53-INDUCED PROTEIN 11.
BRACE20028960//*Mus musculus* mRNA for Ca2+ dependent activator protein for secretion, complete cds.
BRACE20077840//Putative Protein that mediates attachment of autophagosomes to microtubules, by similarity to yeast aut2 [Schizosaccharomyces pombe].
BRACE20093610//Bacterial type II secretion system protein
BRAWH20003230//Proline rich protein
BRAWH20009440//*Arabidopsis thaliana* pollenless3 (178) gene, complete cds; beta-9 tubulin (TUB9) gene, partial cds; and unknown gene.
BRAWH20014610//TS-N domain//UBA domain
BRAWH20060440//PPR repeat
BRAWH20076050//LORICRIN.
CTONG20027210//VACUOLAR PROTEIN SORTING-ASSOCIATED PROTEIN VPS13.
CTONG20028030//Domain of unknown function DUF19//Ribosomal protein S18
CTONG20064490//*Drosophila melanogaster* 26S proteasome regulatory complex subunit p42A mRNA, complete cds.
DFNES20004320//*Homo sapiens* ubiquitous TPR-motif protein Y isoform (UTY) gene, partial cds; alternatively spliced.
FCBBF10006870//*Mus musculus* Rap2 interacting protein 8 (RPIP8) mRNA, complete cds.
FCBBF20002320//T-box
FCBBF20002760//ALPHA SCRUIN.
FCBBF20012110//*Leishmania major* partial ppg1 gene for proteophosphoglycan.
FCBBF20016720//Domain of unknown function DUF94
FEBRA20000530//*Drosophila melanogaster* Diablo (dbo) mRNA, complete cds.
FEBRA20005360//*Homo sapiens* paraneoplastic cancer-testis-brain antigen (MA5) mRNA, complete cds.
FEBRA20007570//*Homo sapiens* BM-009 mRNA, complete cds.
FEBRA20011330//26S PROTEASOME REGULATORY SUBUNIT S3 (PROTEASOME SUBUNIT P58).
FEBRA20030540//*Halocynthia roretzi* mRNA for HrPET-1, complete cds.
FEBRA20044900//*R. norvegicus* mRNA for CPG2 protein.
FEBRA20048180//DRR1 PROTEIN (TU3A PROTEIN).
FEBRA20053800//*Homo sapiens* ubiquitous TPR-motif protein Y isoform (UTY) gene, partial cds; alternatively spliced.
FEBRA20057260//TBC domain
FEBRA20068730//Trg protein
HCASM10000210//*Plasmodium berghei* strain NYU2 merozoite surface protein-1 mRNA, partial cds.
HCASM20005360//Macrophage migration inhibitory factor
HEART20004110//POT family
HEART20005680//Nerve growth factor family
HHDPC20001150//*Mus musculus* putative secreted protein ZSIG37 (Zsig37) mRNA, complete cds.
HHDPC20001490//*Mus musculus* partial mRNA for muscle protein 534 (mg534 gene).
HHDPC20004560//2S seed storage family
HHDPC20004620//FAD binding domain
HSYRA10001190//PROBABLE GYP7 PROTEIN (FRAGMENT).
HSYRA10001780//Alpha-2-macroglobulin family N-terminal region
HSYRA20001350//CELL POLARITY PROTEIN TEA1.
HSYRA20014760//von Willebrand factor type A domain
HSYRA20016210//HesB-like domain
IMR3220002230//HINT PROTEIN (PROTEIN KINASE C INHIBITOR 1) (PKCI-1) (17 KD INHIBITOR OF PROTEIN KINASE C).
IMR3220014910//*Rattus norvegicus* tricarboxylate carrier-like protein mRNA, complete cds.
KIDNE10001520//*Mus musculus* yolk sac permease-like molecule 1 (YSPL-1) mRNA, complete cds.
KIDNE20003750//*Mus musculus* mRNA for granuphilin-a, complete cds.
KIDNE20005740//*Staphylococcus epidermidis* putative cell-surface adhesin SdrF (sdrF) gene, complete cds.
KIDNE20043440//Vacuolar protein sorting-associated protein—fission yeast
KIDNE20056760//NEURONAL PROTEIN.
KIDNE20060300//*Gallus gallus* syndesmos mRNA, complete cds.
KIDNE20062480//Scorpion short toxins
KIDNE20067750//*Homo sapiens* PTOV1 (PTOV1) gene, complete cds.
LIVER10000790//*Rattus norvegicus* fertility related protein WMP1 mRNA, complete cds.
MAMGL10000560//K-box region
MESAN10001010//Rat trg gene product
NB9N420004950//PROBABLE NUCLEAR ANTIGEN.
NT2NE10000180//SUPPRESSOR PROTEIN SRP40.
NT2NE10000630//*Gallus gallus* Dach2 protein (Dach2) mRNA, complete cds.
NT2NE20007630//Matrix protein (MA), p15
NT2NE20013370//*Homo sapiens* estrogen-responsive B box protein (EBBP) mRNA, complete cds.
NT2NE20016970//MSF1 PROTEIN.
NT2NE20035690//*Homo sapiens* phosphoinositol 3-phosphate-binding protein-2 (PEPP2) mRNA, complete cds.
NT2NE20053710//Ank repeat
NT2RI20006690//TRICHOHYALIN.
NT2RI20013420//*Mus musculus* cyclin ania-6b mRNA, partial cds.
NT2RI20013850//*Homo sapiens* P38IP (P38IP) mRNA, complete cds.
NT2RI20015190//*Homo sapiens* misato mRNA, partial cds.
NT2RI20016210//Probable transposase—human transposon MER37

NT2RI20022700//X123 protein
NT2RI20025170//*Homo sapiens* PAR3 (PAR3) mRNA, complete cds.
NT2RI20029260//ARP2/3 COMPLEX 16 KDA SUBUNIT (P16-ARC).
NT2RI20029700//EF hand//EF hand
NT2RI20043040//*Homo sapiens* NY-REN-2 antigen mRNA, complete cds.
NT2RI20046060//K+ channel tetramerisation domain
NT2RI20061830//Proline-rich protein M14 precursor
NT2RI20065060//*Drosophila melanogaster* rudimentary gene, intron 3; anon-15AB gene, complete cds.
NT2RI20077230//*Homo sapiens* BRI3 mRNA, complete cds.
NT2RI20082210//CORNIFIN B (SMALL PROLINE-RICH PROTEIN 1B) (SPR1B) (SPR1B).
NT2RI20088120//AXONEME-ASSOCIATED PROTEIN MST101(2).
NT2RI20091440//SPRY domain
NT2RP60000080//*Homo sapiens* Pig11 (PIG11) mRNA, complete cds.
NT2RP60000720//*Pinus taeda* clone PtaAGP6 putative arabinogalactan protein mRNA, complete cds.
NT2RP70009060//*Medicago truncatula* mRNA for 85p protein (85p gene).
NT2RP70010800//*Mus musculus* mRNA for MILI (Miwi like), complete cds.
NT2RP70022430//Tax1-binding protein TRX—human.
NT2RP70028290//Scm-related gene containing four mbt domains [*Mus musculus*].
NT2RP70033040//YceA protein homolog ybfq—*Bacillus subtilis*.
NT2RP70036320//Microfilarial sheath protein
NT2RP70039600//Calpain inhibitor repeat
NT2RP70042330//HYPOTHETICAL PROTEIN MJ0941.
NT2RP70049150//*Mus musculus* mRNA for UBE-1c1, UBE-1c2, UBE-1c3, complete cds.
NT2RP70052050//Human transformation—related protein mRNA, 3' end.
NT2RP70084410//Polybromo 1 protein—chicken
NTONG10000520//*Rattus norvegicus* mRNA for Kelch related protein 1 (krpl gene).
NTONG10001230//*Mus msuculus* mRNA, partial cds, clone CLFEST42.
OCBBF10001220//RING CANAL PROTEIN (KELCH PROTEIN).
OCBBF20010750//Spectrin repeat
OCBBF20011400//VACUOLAR PROTEIN SORTING—ASSOCIATED PROTEIN VPS8.
OCBBF20014020//*Mus musculus* NSD1 protein mRNA, complete cds.
PEBLM10001440//Trg
PEBLM20002130//*Mus musculus* genes for integrin aM290, hapsin, partial and complete cds.
PLACE50000370//*Homo sapiens* mRNA for hVPS11, complete cds.
PLACE60004290//Gag P30 core shell protein
PLACE60021020//Integrase Zinc binding domain//Integrase Zinc binding domain//DnaJ central domain (4 repeats)
PLACE60024190//TRICHOHYALIN.
PLACE60032040//Hirudin
PLACE60033990//SPIDROIN 1 (DRAGLINE SILK FIBROIN 1) (FRAGMENT).
PLACE60038500//*Homo sapiens* mitochondrial solute carrier mRNA, complete cds.
PLACE60043970//Takifugu rubripes retinitis pigmentosa GTPase regulator-like protein gene, partial cds.
PLACE60044640//Human placenta (Diff48) mRNA, complete cds.
PROST20023380//Cca3 protein
PROST20034720//IMMEDIATE-EARLY PROTEIN.
PROST20079740//ANTER-SPECIFIC PROLINE-RICH PROTEIN APG (PROTEIN CEX) (FRAGMENT).
SALGL10000050//Permeases for cytosine/purines, uracil, thiamine, allantoin
SALGL10000470//NG36 [*Homo sappiens*]
SKMUS20002710//Hepatitis C virus capsid protein
SKMUS20003650//Human (p23) mRNA, complete cds.
SKMUS20004580//*Mus musculus* N-RAP mRNA, complete cds.
SKMUS20009020//BR01 PROTEIN.
SKMUS20009540//*Homo sapiens* F-box protein Fbx25 (FBX25) mRNA, partial cds.
SKMUS20010080//*Mus musculus* mRNA for a skeletal muscle and cardiac protein.
SKMUS20011470//*Mus musculus* RP42 mRNA, complete cds.
SKMUS20013640//Laminin EGF-like (Domains III and V)
SKMUS20015430//*Homo sapiens* HDCMC29P mRNA, partial cds.
SKNMC20010570//F-box domain.
SMINT20001450//Halocynthia roretzi mRNA for HrPET-3, complete cds.
SMINT20002270//Disintegrin//Trans-activation protein X
SMINT20003960//A kinase anchor protein AKAP-KL isoform 2
STOMA20002890//Adaptin N terminal region
SYNOV20002910//Arabinogalactan-like protein
SYNOV20008200//Trichoplusia ni transposon IFP2.
TESTI10000250//*M. musculus* mRNA for testis-specific protein, DDC8.
TESTI10000640//Fugu rubripes sex comb on midleg-like 2 protein (SCML2) gene, complete cds.
TESTI10001910//*Homo sapiens* 88-kDa Golgi protein (GM88) mRNA, complete cds.
TESTI20000440//TRICHOHYALIN.
TESTI20002070//NIFU-LIKE PROTEIN.
TESTI20002080//*Homo sapiens* mRNA for Gab2, complete cds.
TESTI20014120//TRICHOHYALIN.
TESTI20016650//IMMEDIATE-EARLY PROTEIN.
TESTI20022230//*Chlamydomonas reinhardtii* strain 1132D-flagellar protofilament ribbon protein (RIB43a) mRNA, complete cds.
TESTI20022940//MOB2 PROTEIN (MPS1 BINDER 2).
TESTI20024610//TRICHOHYALIN.
TESTI20030590//TESTIS-SPECIFIC PROTEIN PBS13.
TESTI20030740//TRICHOHYALIN.
TESTI20031300//TPR Domain
TESTI20033560//F-box domain.
TESTI20035510//Proliferating-cell nucleolar antigen P120-like protein—*Archaeoglobus fulgidus*.
TESTI20035740//A-KINASE ANCHOR PROTEIN 150 (AKAP 150) (CAMP-DEPENDENT PROTEIN KINASE REGULATORY SUBUNIT II HIGH AFFINITY BINDING PROTEIN) (P150) (FRAGMENT).
TESTI20038940//IQ calmodulin-binding motif//IQ calmodulin-binding motif//IQ calmodulin-binding motif
TESTI20040310//Protein of unknown function DUF84
TESTI20041220//*Babesia bigemina* 200 kDa antigen p200 mRNA, partial cds.
TESTI20052680//*Rattus norvegicus* RSD-6 mRNA, complete cds.
TESTI20054080//SER/THR-RICH PROTEIN T10 IN DGCR REGION.

TESTI20065720//PROTEIN D52 (N8 PROTEIN).
TESTI20078670//RING CANAL PROTEIN (KELCH PROTEIN).
TESTI20080330//Ribosomal protein L14p/L23e
TESTI20083430//TPR Domain
THYMU10000020//*Homo sapiens* mRNA for Golgi protein (GPP34 gene).
THYMU10002910//*Homo sapiens* AP-4 adaptor complex beta4 subunit mRNA, complete cds.
THYMU20002360//Pumilio-family RNA binding domains (aka PUM-HD, Pumilio homology domain)
TRACH10000300//Anabaena PCC7120 hetC gene, complete cds.
TRACH20007800//*Homo sapiens* PTH-responsive osteosarcoma B1 protein (B1) mRNA, complete cds.
TRACH20008940//PROTEIN TSG24 (MEIOTIC CHECK POINT REGULATOR).
TRACH20013950//*Homo sapiens* NY-REN-25 antigen mRNA, partial cds.
UMVEN10001220//Corticotropin-releasing factor family With respect to the remaining 476 clones, there are so far no information available for estimating their functions. However, there is the possibility that the functions of these clones will be revealed in future. Their Clone Names are indicated below.

3NB6920013490, 3NB6920016370, 3NB6920017190, ADRGL10001820, ADRGL20004280, ASTRO20004800, BGGI110002850, BNGH410000130, BNGH410000170, BNGH410000330, BNGH410001530, BNGH420004740, BRACE10000200, BRACE10000700, BRACE10001590, BRACE20000770, BRACE20001000, BRACE20001410, BRACE20003320, BRACE20004210, BRACE20005050, BRACE20005450, BRACE20009880, BRACE20010700, BRACE20011880, BRACE20013740, BRACE20015430, BRACE20016920, BRACE20018650, BRACE20018980, BRACE20020500, BRACE20021510, BRACE20021760, BRACE20024950, BRACE20025900, BRACE20027520, BRACE20028600, BRACE20028610, BRACE20032850, BRACE20033190, BRACE20033980, BRACE20034310, BRACE20035160, BRACE20035270, BRACE20035390, BRACE20035940, BRACE20071530, BRACE20072010, BRACE20072320, BRACE20075270, BRACE20075630, BRACE20076210, BRACE20076460, BRACE20077080, BRACE20077270, BRACE20077670, BRACE20077680, BRACE20079020, BRACE20081140, BRACE20084800, BRACE20084880, BRACE20086530, BRACE20087080, BRACE20087540, BRACE20088570, BRACE20089990, BRACE20090140, BRACE20092740, BRACE20092750, BRACE20093110, BRACE20094370, BRACE20095170, BRAWH1000070, BRAWH10001740, BRAWH20000930, BRAWH20002480, BRAWH20005540, BRAWH20008660, BRAWH20008920, BRAWH20011030, BRAWH20047310, BRAWH20064930, BRAWH20069600, BRAWH20074060, BRAWH20089030, BRAWH20092270, BRAWH20094850, CTONG20003030, CTONG20007710, CTONG20008270, CTONG2002.0730, CTONG20021430, CTONG20024530, CTONG20029650, DFNES20002920, FCBBF10006860, FCBBF10006910, FCBBF10007320, FCBBF10007600, FCBBF20001050, FCBBF20001950, FCBBF20005760, FCBBF20006770, FCBBF20008080, FCBBF20012990, FCBBF20014800, FCBBF20017180, FCBBF20017200, FEBRA20003300, FEBRA20003910, FEBRA20006800, FEBRA20007400, FEBRA20007710, FEBRA20008740, FEBRA20009010, FEBRA20009590, FEBRA20011970, FEBRA20015900, FEBRA20015910, FEBRA20021940, FEBRA20027270, FEBRA20027830, FEBRA20028820, FEBRA20028970, FEBRA20029080, FEBRA20033080, FEBRA20042240, FEBRA20042370, FEBRA20042930, FEBRA20044120, FEBRA20044430, FEBRA20053770, FEBRA20054270, FEBRA20057520, FEBRA20059980, FEBRA20061500, FEBRA20063540, FEBRA20066270, FEBRA20074140, FEBRA20074580, FEBRA20076220, HCASM10001150, HCASM20005340, HLUNG10000300, HLUNG20003140, HLUNG20004120, HLUNG20004800, HLUNG20005010, HSYRA10001480, HSYRA20002480, HSYRA20002530, HSYRA20007600, HSYRA20011530, IMR3210000740, IMR3210000750, IMR3210001650, IMR3220006090, IMR3220009350, IMR3220009530, IMR3220011850, IMR3220016000, IMR3220017240, KIDNE10000280, KIDNE10000500, KIDNE10001450, KIDNE20001920, KIDNE20002440, KIDNE20002450, KIDNE20002660, KIDNE20033350, KIDNE20033770, KIDNE20037520, KIDNE20040340, KIDNE20040540, KIDNE20042940, KIDNE20045200, KIDNE20045340, KIDNE20045790, KIDNE20048640, KIDNE20048790, KIDNE20059370, KIDNE20070050, KIDNE20070770, KIDNE20073560, LIVER10000990, LIVER10002780, LIVER10003030, LIVER20004460, LIVER20005150, MAMGL10000350, MESAN20002670, MESAN20003370, NB9N410001210, NB9N410001460, NHNPC10001010, NT2NE10000040, NT2NE10001200, NT2NE20000380, NT2NE20000560, NT2NE20000640, NT2NE20006360, NT2NE20007060, NT2NE20007870, NT2NE20008020, NT2NE20009800, NT2NE20011560, NT2NE20013240, NT2NE20013640, NT2NE20014030, NT2NE20014280, NT2NE20015300, NT2NE20016230, NT2NE20016480, NT2NE20044900, NT2RI10000160, NT2RI10001640, NT2RI20000640, NT2RI20002700, NT2RI20002940, NT2RI20006710, NT2RI20007380, NT2RI20008650, NT2RI20012350, NT2RI20012440, NT2RI20014100, NT2RI20017260, NT2RI20026540, NT2RI20028020, NT2RI20028520, NT2RI20030190, NT2RI20030670, NT2RI20033040, NT2RI20033380, NT2RI20035560, NT2RI20046590, NT2RI20043980, NT2RI20047830, NT2RI20048400, NT2RI20049160, NT2RI20049840, NT2RI20056280, NT2RI20061270, NT2RI20063450, NT2RI20064870, NT2RI20065530, NT2RI20066670, NT2RI20067880, NT2RI20071160, NT2RI20072140, NT2RI20073860, NT2RI20075070, NT2RI20075720, NT2RI20075890, NT2RI20077290, NT2RI20077510, NT2RI20085260, NT2RI20086560, NT2RI20088010, NT2RI20090830, NT2RP60000170, NT2RP60000590, NT2RP70000410, NT2RP70003910, NT2RP70005790, NT2RP70013350, NT2RP70024490, NT2RP70025540, NT2RP70028410, NT2RP70030500, NT2RP70030910, NT2RP70047510, NT2RP70047660, NT2RP70049750, NT2RP70052190, NT2RP70054680, NT2RP70054930, NT2RP70063740, NT2RP70066210, NT2RP70067010,

NT2RP70069800, NT2RP70071140, NT2RP70073590, NT2RP70079300, NT2RP70081420, NT2RP70086230, NT2RP70092150, NT2RP70092590, NT2RP70093630, NT2RP70093970, NT2RP70094660, NT2RP70095020, NTONG10000330, NTONG20005830, NTONG20009850, NTONG20011370, NTONG20014280, OCBBF10000670, OCBBF10000860, OCBBF10001040, OCBBF20000130, OCBBF20001260, OCBBF20002870, OCBBF20009040, OCBBF20017060, PANCR10001850, PEBLM10000290, PEBLM10001800, PEBLM20000300, PEBLM20001260, PEBLM20001470, PLACE50001530, PLACE60000440, PLACE60000700, PLACE60000800, PLACE60001370, PLACE60002630, PLACE60003710, PLACE60004240, PLACE60005230, PLACE60005500, PLACE60009530, PLACE60012940, PLACE60019230, PLACE60019250, PLACE60026920, PLACE60029490, PLACE60030940, PLACE60031090, PLACE60033720, PLACE60037400, PLACE60040050, PLACE60043120, PLACE60043360, PLACE60044910, PLACE60046870, PLACE60049310, PROST10001520, PROST10002460, PROST10005640, PROST20002060, PROST20002670, PROST20002740, PROST20004630, PROST20017390, PROST20017960, PROST20019980, PROST20021620, PROST20025910, PROST20028420, PROST20031020, PROST20032100, PROST20033030, PROST20037320, PROST20044810, PROST20056040, PROST20061960, PUAEN10000810, SKMUS10001240, SKMUS20003430, SKMUS20004670, SKMUS20004680, SKMUS20008470, SKMUS20009450, SKMUS20015010, SKMUS20016080, SKMUS20016310, SKMUS20016710, SKNMC10000070, SKNMC10000100, SKNMC10001100, SKNMC10001590, SKNMC10001680, SKNMC10002640, SKNMC20003050, SKNMC20005930, SKNMC20006120, SKNMC20015550, SKNSH10000860, SKNSH10003080, SKNSH20001510, SKNSH20001630, SMINT10000390, SMINT10000540, SMINT20000400, SMINT20002390, SMINT20005580, SPLEN10000490, SPLEN20000470, SPLEN20002420, SPLEN20004430, SPLEN20005410, STOMA10000470, STOMA10001330, STOMA20001880, STOMA20004780, SYNOV10001640, SYNOV20011440, SYNOV20014570, TESTI10000230, TESTI10001250, TESTI10001630, TESTI10001790, TESTI20000180, TESTI20001790, TESTI20003720, TESTI20004620, TESTI20005200, TESTI20006710, TESTI20008190, TESTI20008300, TESTI20009510, TESTI20010080, TESTI20010820, TESTI20013060, TESTI20015930, TESTI20017580, TESTI20017660, TESTI20017920, TESTI20018260, TESTI20018290, TESTI20018980, TESTI20019500, TESTI20019680, TESTI20019910, TESTI20020480, TESTI20020900, TESTI20022450, TESTI20022640, TESTI20023610, TESTI20023690, TESTI20024150, TESTI20025440, TESTI20028060, TESTI20028400, TESTI20029650, TESTI20032550, TESTI20032800, TESTI20032990, TESTI20033760, TESTI20034180, TESTI20035410, TESTI20035800, TESTI20037270, TESTI20041110, TESTI20042430, TESTI20049290, TESTI20051550, TESTI20054920, TESTI20062380, TESTI20062550, TESTI20064250, TESTI20069790, TESTI20073580, TESTI20074020, TESTI20076130, TESTI20077500, TESTI20081390, TESTI20082340, TESTI20082400, TESTI20084400, THYMU10000320, THYMU10001050, THYMU10003660, THYMU10004730, THYMU10005270, THYMU20001400, TRACH10000180, TRACH10000570, TRACH10001060, TRACH20002350, TRACH20004610, TRACH20011920, TRACH20014000, UTERU20003380, UTERU20005410, UTERU20005690

EXAMPLE 7

Expression Frequency Analysis in Silico

The CDNA libraries derived from various tissues and cells as indicated in Example 1 were prepared, and cDNA clones were selected from each library at random. The 5′-end sequences were determined and the database was constructed based on the data. The database was constructed based on the nucleotide sequences of 770,546 clones, and thus the population of the database is large enough for the analysis.

Then, clones having a homologous sequence are categorized into a single cluster (clustering) by searching the nucleotide sequences of respective clones in this database with the program of nucleotide sequence homology search; the number of clones belonging to each cluster was determined and normalized for every library; thus, the ratio of a certain gene in each cDNA library was determined. This analysis gave the information of the expression frequency of genes in tissues and cells which were sources of the cDNA libraries.

Then, in order to analyze the expression of a gene containing the. nucleotide sequence of the cDNA of the present invention in tissues and cells, the library derived from a tissue or a cell used in the large-scale cDNA analysis was subjected to the comparison of the expression levels between tissues or cells. Namely, the expression frequency was analyzed by comparing the previously normalized values between tissues and/or cells for which the nucleotide sequences of 600 or more cDNA clones had been analyzed. By this analysis, some of the genes were revealed to be involved in the pathology and functions indicated below. Each value in Tables 3 to 39 shown below represents a relative expression frequency; the higher the value, the higher the expression level.

Osteoporosis-Related Genes

Osteoporosis is a pathology in which bones are easily broken owing to overall decrease in components of bone. The onset involves the balance between the functions of osteoblast producing bone and osteoclast absorbing bone, namely bone metabolism. Thus, the genes involved in the increase of osteoclasts differentiating from precursor cells of monocyte-macrophage line (Molecular Medicine 38. 642–648. (2001)) are genes involved in osteoporosis relevant to bone metabolism.

A nucleotide sequence information-based analysis was carried out to identify the genes whose expression frequencies are higher or lower in CD34+ cell (cell expressing a glycoprotein CD34) treated with the osteoclast differentiation factor (Molecular Medicine 38. 642–648. (2001)) than in the untreated CD34+ cell, which is the precursor cell of monocyte/macrophage line. The result of comparative analysis for the frequency between the two cDNA libraries prepared from the RNA of CD34+ cells (CD34C) and from the RNA of CD34+ cells treated with the osteoclast differentiation factor (D30ST, D60ST or D90ST) showed that the genes whose expression levels were different between the two were the following clones (Table 3).

KIDNE20062480, NT2RI20016570, PLACE60020840, 3NB6920002810BRACE20035270, BRAWH20000340,

FEBRA20062700, HSYRA20011030, NT2RP70030910, OCBBF20011240, PLACE60043120, SYNOV20011440, HCASM10001150, IMR3220016000, NT2RI20082210, D3OST20001840, FEBRA20012940, FEBRA20021910, IMR3220002230, IMR3220012180, NT2RI20000640, NT2RI20010910, NT2RI20058110, NT2RP60000350, NT2RP70011660, PEBLM20003950, PLACE60049310, PROST20062600, TESTI20007840, TESTI20040310, TESTI20080200, THYMU10003590, TRACH10000630, TRACH20007800, CD34C20000510, HSYRA20016210, KIDNE20004030, KIDNE20073280, NT2RP70055020, PLACE60043960, SKMUS10000220

These genes are involved in osteoporosis.

Genes Involved in Neural Cell Differentiation

Genes involved in neural cell differentiation are useful for treating neurological diseases. Genes with varying expression levels in response to induction of cellular differentiation in neural cells are thought to be involved in neurological diseases.

A survey was performed for genes whose expression levels are varied in response to induction of differentiation (stimulation by retinoic acid (RA) or growth inhibitor treatment after RA stimulation) in cultured cells of a neural strain, NT2. The result of comparative analysis of cDNA libraries derived from undifferentiated NT2 cells (NT2RM) and the cells subjected to the differentiation treatment (NT2RP, NT2RI or NT2NE) showed that the genes whose expression levels were different between the two were the following clones (Table 4).

SKNMC20000970, 3NB6920009120, BRAWH20006970, KIDNE20062480, NHNPC20002060, NT2NE20053710, NT2RI20000640, NT2RI20004210, NT2RI20006710, NT2RI20009740, NT2RI20013420, NT2RI20013850, NT2RI20014100, NT2RI20025410, NT2RI20033040, NT2RI20035560, NT2RI20036950, NT2RI20051500, NT2RI20053350, NT2RI20057230, NT2RI20071330, NT2RI20075720, NT2RI20083960, NT2RI20087910, NT2RI20090650, NT2RI20094060, NT2RP60000350, NT2RP70000760, NT2RP70036800, NT2RP70071770, NT2RP70074220, TESTI20007840, TESTI20080200, 3NB6920002810, 3NB6920005450, HSYRA20015740, HSYRA20016210, IMR3220016000, KIDNE20060140, NT2RI20014490, NT2RI20015950, NT2RI20022520, NT2RI20025170, NT2RI20025540, NT2RI20030510, NT2RI20040590, NT2RI20046060, NT2RI20053680, NT2RI20058510, NT2RI20066820, NT2RI20067030, NT2RI20074980, NT2RI20075890, NT2RI20078840, NT2RI20084810, NT2RI20089420, NT2RP70002380, NT2RP70023790, NT2RP70029820, NT2RP70049150, NT2RP70055020, NT2RP70065270, NT2RP70069860, NT2RP70075370, NT2RP70079750, NT2RP70092590, OCBBF20000130, PLACE60043970, TESTI20053960, BNGH420004740, HSYRA20002480, NT2NE10000730, NT2NE20000560, NT2NE20003270, NT2NE20008090, NT2NE20014030, NT2RP60000720, NT2RP60001090, NT2RP70004770, NT2RP70010800, NT2RP70011660, NT2RP70028750, NT2RP70029060, NT2RP70030550, NT2RP70032030, NT2RP70036320, NT2RP70064900, NT2RP70093220, NT2RP70093730, SYNOV20013740, TESTI20021490, TRACH20004720, TRACH20007800, 3NB6920003300, BRACE10000200, BRACE20018550, FEBRA20008740, FEBRA20074580, FEBRA20076220, KIDNE20073520, MAMGL10000320, NT2NE20002140, NT2NE20006360, NT2NE20007870, NT2NE20009800, NT2NE20035690, NT2RI20002940, NT2RI20014500, NT2RI20016210, NT2RI20029260, NT2RI20037510, NT2RI20055640, NT2RI20064120, NT2RI20074390, NT2RI20077230, NT2RI20090660, PLACE60040050, TRACH20012890, 3NB6910001730, BRACE10001150, BRACE20011170, BRACE20020910, BRACE20035270, BRAWH20005220, FEBRA20003970, FEBRA20012450, HLUNG20003140, IMR3220009350, IMR3220013170, IMR3220013320, IMR3220014350, NT2NE10000040, NT2NE10000140, NT2NE10000180, NT2NE10000230, NT2NE10000630, NT2NE10000830, NT2NE10001200, NT2NE10001630, NT2NE10001850, NT2NE20000380, NT2NE20000640, NT2NE20001740, NT2NE20002590, NT2NE20002990, NT2NE20003690, NT2NE20003840, NT2NE20003920, NT2NE20004550, NT2NE20004700, NT2NE20005170, NT2NE20005360, NT2NE20005500, NT2NE20005860, NT2NE20006580, NT2NE20007060, NT2NE20007630, NT2NE20008020, NT2NE20011560, NT2NE20012470, NT2NE20013240, NT2NE20013370, NT2NE20013640, NT2NE20013720, NT2NE20014280, NT2NE20014350, NT2NE20015300, NT2NE20016230, NT2NE20016260, NT2NE20016340, NT2NE20016480, NT2NE20016660, NT2NE20016970, NT2NE20034080, NT2NE20044900, NT2NE20047160, NT2NE20054410, NT2NE20055170, NT2NE20057200, OCBBF20009040, OCBBF20015860, PLACE60020840, PROST10005260, SKMUS20008630, SMINT20003960, STOMA20001210, SYNOV20011440, TESTI10000230, TESTI20009700, TESTI20040310, THYMU10003290, TRACH20013950, BGGI120010970, BNGH410001980, BRACE10001660, BRACE20014770, BRACE20034490, BRACE20071740, BRAWH20009440, BRAWH20036930, CTONG20020730, CTONG20028030, FCBBF10006750, FCBBF20012110, FCBBF20015380, FEBRA20007570, FEBRA20043250, FEBRA20068730, HCASM10001150, HCASM20002140, HHDPC20000950, HHDPC20004620, HSYRA10001370, HSYRA10001780, HSYRA20001350, HSYRA20006050, IMR3210001580, IMR3220002230, IMR3220003020, KIDNE20004030, KIDNE20060300, KIDNE20073280, MESAN20005010, NT2RI10000160, NT2RI10000270, NT2RI10000480, NT2RI10001640, NT2RI20002700, NT2RI20002820, NT2RI20003410, NT2RI20004120, NT2RI2.0005970, NT2RI20006690, NT2RI20006850, NT2RI20007380, NT2RI20008650, NT2RI20010100, NT2RI20010830, NT2RI20010910, NT2RI20012350, NT2RI20012440, NT2RI20014090, NT2RI20015190, NT2RI20015400, NT2RI20016570, NT2RI20017260, NT2RI20018460, NT2RI20018660, NT2RI20020220, NT2RI20020410, NT2RI20021520, NT2RI20022430, NT2RI20022700, NT2RI20025300, NT2RI20025850, NT2RI20026540, NT2RI20028020, NT2RI20028520, NT2RI20029580, NT2RI20029700, NT2RI20030110, NT2RI20030190, NT2RI20030670, NT2RI20031540, NT2RI20032050, NT2RI20032220, NT2RI20033010, NT2RI20033380, NT2RI20033440, NT2RI20033830, NT2RI20036780, NT2RI20041900, NT2RI20042840, NT2RI20043040, NT2RI20043980, NT2RI20044420, NT2RI20047830, NT2RI20048400, NT2RI20049160, NT2RI20049840, NT2RI20049850, NT2RI20050610, NT2RI20050870, NT2RI20056280, NT2RI20056470, NT2RI20058110, NT2RI20060710, NT2RI20060720, NT2RI20061270, NT2RI20061830, NT2RI20062100, NT2RI20063450, NT2RI20064870, NT2RI20065060, NT2RI20065530, NT2RI20066670, NT2RI20066790, NT2RI20067350, NT2RI20067880, NT2RI20068250, NT2RI20068550,

NT2RI20070480, NT2RI20070840, NT2RI20070960, NT2RI20071160, NT2RI20071480, NT2RI20072140, NT2RI20072540, NT2RI20073030, NT2RI20073840, NT2RI20073860, NT2RI20074690, NT2RI20075070, NT2RI20077290, NT2RI20077510, NT2RI20077540, NT2RI20078270, NT2RI20078790, NT2RI20078910, NT2RI20080500, NT2RI20081880, NT2RI20082210, NT2RI20083360, NT2RI20085260, NT2RI20085980, NT2RI20086560, NT2RI20087140, NT2RI20087490, NT2RI20088010, NT2RI20088120, NT2RI20090830, NT2RI20091440, NT2RI20092150, NT2RI20092890, NTONG10001820, OCBBF20002770, OCBBF20011240, PEBLM10001440, PLACE50001130, PLACE60014430, PROST20029600, PUAEN10000570, SALGL10001570, SKMUS10000220, SKMUS20004670, STOMA20002890, SYNOV10001280, TESTI20012690, TESTI20023690, TESTI20028660, TESTI20068720, THYMU10000020, THYMU10000830, TRACH20002370, 3NB6910001290, BRACE10000700, BRACE20003320, BRACE20015080, BRACE20079020, BRACE20083800, BRACE20092740, FEBRA20008810, FEBRA20017150, FEBRA20067930, HHDPC20000550, HSYRA20008280, HSYRA20014760, KIDNE10001450, KIDNE20000850, KIDNE20002660, KIDNE20003300, KIDNE20033050, KIDNE20045340, NT2RP60000080, NT2RP60000170, NT2RP60000320, NT2RP60000390, NT2RP60000590, NT2RP60000860, NT2RP60001000, NT2RP60001230, NT2RP60001270, NT2RP70000410, NT2RP70000690, NT2RP70002590, NT2RP70002710, NT2RP70003640, NT2RP70003910, NT2RP70004250, NT2RP70005790, NT2RP70006240, NT2RP70008120, NT2RP70009060, NT2RP70012310, NT2RP70013060, NT2RP70013350, NT2RP70015910, NT2RP70018560, NT2RP70021510, NT2RP70022430, NT2RP70023760, NT2RP70024490, NT2RP70024500, NT2RP70025540, NT2RP70026190, .NT2RP70028290, NT2RP70028410, NT2RP70030500, NT2RP70030910, NT2RP70033040, NT2RP70036290, NT2RP70036470, NT2RP70039600, NT2RP70040800, NT2RP70042040, NT2RP70042330, NT2RP70042600, NT2RP70043730, NT2RP70043960, NT2RP70045410, NT2RP70046560, NT2RP70046870, NT2RP70047510, NT2RP70047660, NT2RP70047900, NT2RP70049250, NT2RP70049750, NT2RP70052050, NT2RP70052190, NT2RP70054680, NT2RP70054930, NT2RP70055130, NT2RP70055200, NT2RP70061620, NT2RP70061880, NT2RP70062960, NT2RP70063040, NT2RP70063740, NT2RP70064080, NT2RP70066210, NT2RP70067010, NT2RP70069800, NT2RP70071140, NT2RP70071540, NT2RP70072210, NT2RP70072520, NT2RP70073590, NT2RP70073810, NT2RP70074060, NT2RP70075040, NT2RP70076100, NT2RP70076170, NT2RP70076430, NT2RP70079250, NT2RP70079300, NT2RP70081330, NT2RP70081370, NT2RP70081420, NT2RP70081440, NT2RP70081670, NT2RP70083150, NT2RP70084060, NT2RP70084410, NT2RP70084870, NT2RP70085500, NT2RP70085570, NT2RP70086230, NT2RP70087200, NT2RP70088550, NT2RP70090120, NT2RP70090190, NT2RP70091490, NT2RP70091680, NT2RP70092150, NT2RP70092360, NT2RP70093630, NT2RP70093700, NT2RP70093940, NT2RP70093970, NT2RP70094290, NT2RP70094660, NT2RP70094810, NT2RP70094980, NT2RP70095020, NT2RP70095070, NTONG10000980, NTONG10002140, NTONG20002650, NTONG20016120, PEBLM20003950, PROST10005640, PROST20003250, SKNMC20000650, SKNSH10000860, SKNSH20003470, TESTI10000510, TESTI10000960, TESTI20015110, TESTI20074640, TRACH20004610

These genes are neurological disease-related genes.

Cancer-Related Genes

It has been assumed that, distinct from normal tissues, cancer tissues express a distinct set of genes, and thus the expression can contribute to the carcinogenesis in tissues and cells. Thus, the genes whose expression patterns in cancer tissues are different from those in normal tissues are cancer-related genes. Search was carried out for the genes whose expression levels in cancer tissues were different from those in normal tissues.

The result of comparative analysis of cDNA libraries derived from breast tumor (TBAES) and normal breast (BEAST) showed that the genes whose expression levels were different between the two were the following clones (Table 5).

3NB6910001730, FCBBF10007600, KIDNE20033050, KIDNE20060300, NT2RI20065530, NT2RP60000720, NT2RP70075370, TRACH20004200, LIVER10000670, LIVER10005420, LIVER20000370

The result of comparative analysis of cDNA libraries derived cervical tumor (TCERX) and normal cervical duct (CERVX) showed that the genes whose expression levels were different between the two were the following clones (Table 6).

BRACE10001590, HHDPC20000950, HSYRA20016210, NT2RI20074980, 3NB6920014330, NT2RI20087490, NT2RP60001090, PROST10002200, SKNMC20003220, STOMA20001210

The result of comparative analysis of cDNA libraries derived from colon tumor (TCOLN) and normal colon (COLON) showed that the genes whose expression levels were different between the two were the following clones (Table 7).

BRACE20028610, BRACE20011170, BRACE20035940, IMR3220013320, NT2NE20053710

The result of comparative analysis of cDNA libraries derived from esophageal tumor (TESOP) and normal esophagus (NESOP) showed that the genes whose expression levels were different between the two were the following clones (Table 8).

KIDNE20005740, MAMGL10000320, NESOP10000870, NT2RI20056470, NTONG20008000

The result of comparative analysis of cDNA libraries derived from kidney tumor (TKIDN) and normal kidney (KIDNE) showed that the genes whose expression levels were different between the two were the following clones (Table 9).

3NB6920002810, ADRGL10000020, BNGH420004740, BRACE10000200, BRACE10000420, BRACE10000730, BRACE10001590, BRACE20005650, BRACE20016730, BRACE20028120, BRACE20077980, BRACE20083800, BRACE20083850, BRAWH10001740, BRAWH20036930, BRAWH20064500, BRAWH20064930, CTONG20028030, FCBBF20015380, FEBRA20005360, FEBRA20007570, FEBRA20008740, FEBRA20012270, FEBRA20025250, HSYRA20002480, HSYRA20006400, HSYRA20008280, HSYRA20015740, HSYRA20016210, IMR3220009350, LIVER10001110, NT2NE20003920, NT2NE20007630, NT2NE20007870, NT2RI20025410, NT2RI20026540, NT2RI20029580, NT2RI20033380, NT2RI20033830, NT2RI20051500, NT2RI20058110, NT2RI20090650,

NT2RP60000720, NT2RP70013350, NT2RP70023790, NT2RP70024490, NT2RP70028750, NT2RP70029060, NT2RP70036800, NT2RP70075370, NT2RP70076100, NTONG10000980, NTONG10002460, NTONG20015500, OCBBF20002310, OCBBF20013070, PEBLM20001470, PEBLM20003950, PLACE60021510, PLACE60040050, PLACE60043970, PROST20051430, STOMA20001210, STOMA20002570, STOMA20002890, SYNOV20011440, TESTI10000230, TESTI20009700, TESTI20021490, TESTI20032800, TESTI20053960, TESTI20080200, TESTI20082400, BGGI120010970, BRACE20004210, BRACE20005250, BRACE20011170, BRACE20020910, BRACE20080970, BRAWH20000340, BRAWH20006970, BRAWH20011660, FCBBF20001950, FEBRA20043250, HLUNG10000640, IMR3220007420, IMR3220014350., KIDNE10000080, KIDNE10000280, KIDNE10000500, KIDNE10001040, KIDNE10001430, KIDNE10001450, KIDNE10001520, KIDNE20000410, KIDNE20000510, KIDNE20000700, KIDNE20000850, KIDNE20001670, KIDNE20001920, KIDNE20002440, KIDNE20002450, KIDNE20002660, KIDNE20003150, KIDNE20003300, KIDNE20003490, KIDNE20003750, KIDNE20004030, KIDNE20004220, KIDNE20004970, KIDNE20005130, KIDNE20005170, KIDNE20005190, KIDNE20005740, KIDNE20031850, KIDNE20033050, KIDNE20033350, KIDNE20033570, KIDNE20033730, KIDNE20033770, KIDNE20037520, KIDNE20039410, KIDNE20039940, KIDNE20040340, KIDNE20040540, KIDNE20040840, KIDNE20042620, KIDNE20042940, KIDNE20042950, KIDNE20043440, KIDNE20044110, KIDNE20045200, KIDNE20045340, KIDNE20045790, KIDNE20046810, KIDNE20048280, KIDNE20048640, KIDNE20048790, KIDNE20049810, KIDNE20050420, KIDNE20052960, KIDNE20053360, KIDNE20054000, KIDNE20054770, KIDNE20056290, KIDNE20056760, KIDNE20059080, KIDNE20059370, KIDNE20060140, KIDNE20060300, KIDNE20060530, KIDNE20060620, KIDNE20061490, KIDNE20062990, KIDNE20063530, KIDNE20063760, KIDNE20066520, KIDNE20067600, KIDNE20067750, KIDNE20068800, KIDNE20070050, KIDNE20070770, KIDNE20071860, KIDNE20073280, KIDNE20073520, KIDNE20073560, KIDNE20074220, KIDNE20075690, KIDNE20078100, KIDNE20078110, LIVER10000790, MAMGL10000320, NB9N410000470, NT2NE20053710, NT2RI20006710, NT2RI20013420, NT2RI20016570, NT2RI20018460, NT2RI20025540, NT2RI20040590, NT2RI20065530, NT2RI20087490, NT2RI20087910, NT2RP60000350, NT2RP60001230, NT2RP70043730, NT2RP70069860, NT2RP70074220, OCBBF20014940, PLACE60020840, PLACE60043120, PROST10003430, SKNSH20001510, SMINT10000160, SPLEN20000470, SPLEN20001340, SPLEN20003570, STOMA10000470, TESTI10000700, TESTI20027070, TESTI20040310, TRACH10000300, TRACH20000790, TRACH20002500, TRACH20007800

The result of comparative analysis of CDNA libraries derived from liver tumor (TLIVE) and normal liver (LIVER) showed that the genes whose expression levels were different between the two were the following clones (Table 10).

FCBBF50002610, FEBRA20076220, KIDNE20033050, NT2NE20003840, KIDNE20062480, KIDNE20068800, LIVER10000580, LIVER10000670, LIVER10000790, LIVER10000990, LIVER10001040, LIVER10001110, LIVER10001750, LIVER10002300, LIVER10002780, LIVER10003030, LIVER10004330, LIVER10005420, LIVER20000330, LIVER20004160, LIVER20004460, LIVER20005150, NT2NE20002140, NT2RI20030510, NT2RI20043040, . NT2RI20090650, PROST10005640, PROST20032320, SALGL10001570, SMINT10000160, SPLEN20002420, TESTI20002530, TESTI20080200, THYMU10003590, TRACH20004720

The result of comparative analysis of cDNA libraries derived from lung tumor (TLUNG) and normal lung (HLUNG) showed that the genes whose expression levels were different between, the two were the following clones (Table 11).

NT2RI20030110, BNGH410001980, BRACE10000420, BRACE10001150, BRACE20014770, BRACE20018550, BRAWH20006970, BRAWH20014610, FEBRA20008810, FEBRA20015840, FEBRA20044120, HHDPC20001490, HLUNG10000240, HLUNG10000300, HLUNG10000370, HLUNG10000640, HLUNG10000760, HLUNG10000990, HLUNG10001050, HLUNG10001100, HLUNG20000680, HLUNG20001160, HLUNG20001250, HLUNG20001420, HLUNG20001760, HLUNG20002550, HLUNG20003140, .HLUNG20004120, HLUNG20004800, HLUNG20005010, HSYRA20014200, KIDNE20002660, KIDNE20033050, NT2NE20014350, NT2RI20016570, NT2RI20026540, NT2RI20051500, NT2RI20064120, NT2RI20083960, NT2RI20085260, NT2RI20087490, NT2RP70009060, NT2RP70011660, NT2RP70029060, NT2RP70055020, NT2RP70074220, NT2RP70076100, NTONG10002460, NTONG20008000, PLACE60043120, SKMUS20016340, SKNMC20005930, SMINT20000180, SMINT20002390, SMINT20002770, SMINT20003960, STOMA10000470, STOMA20001880, SYNOV20013740, TESTI20036250, TESTI20080200, TRACH20004610

The result of comparative analysis of cDNA libraries derived from ovary tumor (TOVER) and normal ovary (NOVER) showed the genes whose expression levels were different between the two were the following clones (Table 12).

BRACE20011880, TESTI20030710, BRACE20076210, NT2RI20053680, SKMUS20008630, TESTI20005910, TESTI20040310

The result of comparative analysis of cDNA libraries derived from stomach tumor (TSTOM) and normal stomach (STOMA) showed that the genes whose expression levels were different between the two were the following clones (Table 13).

HSYRA20011030, NT2RI20013420, NT2RP70079750, BRACE20003320, HEART20005060, HHDPC20000950, HLUNG20004120, HLUNG20005010, HSYRA20006400, KIDNE10000500, KIDNE20062480, NT2NE20053710, NT2NE20054410, NT2RI20015400, NT2RI20016570, NT2RI20064120, NT2RI20070840, NT2RI20071330, NT2RI20074980, NT2RI20077230, NT2RI20089420, NT2RP70000760, NT2RP70028750, PLACE60014430, PLACE60024190, SKNMC20000970, STOMA10000470, STOMA10000520, STOMA10001170, STOMA10001330, STOMA10001860, STOMA20000320, STOMA20000880, STOMA20001210, STOMA20001880, STOMA20002570,

STOMA20002890, STOMA20003960, STOMA20004780, STOMA20004820, THYMU10003590

The result of comparative analysis of cDNA libraries derived from uterine tumor (TUTER) and normal uterus (UTERU) showed that the genes whose expression levels were different between the two were the following clones (Table 14).

NT2RI20085260, 3NB6920002810, BRACE10000420, BRACE20089990, BRACE20092120, BRAWH10001680, BRAWH20011410, BRAWH20011660, FCBBF20005910, FCBBF50002610, FEBRA20005360, FEBRA20006800, FEBRA20008800, FEBRA20044120, FEBRA20057520, HEART20005060, HHDPC20000950, HLUNG10000760, HLUNG20003140, HSYRA20014200, HSYRA20014760, HSYRA20015800, IMR3210002420, IMR3220002230, IMR3220009350, IMR3220014350, IMR3220016000, KIDNE20000850, KIDNE20060140, KIDNE20060300, MAMGL10000350, NT2NE20035690, NT2NE20053710, NT2RI10000270, NT2RI20000640, NT2RI20002940, NT2RI20010910, NT2RI20013420, NT2RI20016570, NT2RI20033380, NT2RI20036950, NT2RI20037510, NT2RI20053350, NT2RI20057230, NT2RI20058110, NT2RI20071480, NT2RI20074980, NT2RI20084810, NT2RI20087490, NT2RI20087910, NT2RP60000350, NT2RP70032030, NT2RP70043730, NTONG10000980, NTONG10002460, PLACE60014430, PLACE60026680, PLACE60043960, PLACE60044910, PLACE60047380, PROST10002200, PROST10005260, PROST20025910, PROST20033380, PUAEN10000570, SALGL10001570, SKMUS10000140, SKMUS20003430, SKMUS20009540, SKNMC10002510, SKNMC20000970, SKNSH10000860, SMINT20002770, STOMA20002890, SYNOV20011440, TESTI10000230, TESTI20018290, TEST120021490, TESTI20080200, TESTI20082400, TRACH10000300, TRACH20002370, TRACH20007800, TRACH20012890, UTERU10000770, UTERU10000960, UTERU10001600, UTERU10001920, UTERU20000470, UTERU20003380, UTERU20003930, UTERU20004850, UTERU20005410, UTERU20005690

The result of comparative analysis of CDNA libraries derived from tongue cancer (CTONG) and normal tongue (NTONG) showed that the genes whose expression levels were different between the two were the following clones (Table 15).

3NB6910001160, 3NB6910001290, 3NB6910001730, BNGH420004740, BRACE20008850, BRACE20020910, BRACE20074010, BRAWH20014840, BRAWH20089560, CTONG20003030, CTONG20005890, CTONG20007710, CTONG20008270, CTONG20011390, CTONG20013200, CTONG20013660, CTONG20015330, CTONG20018200, CTONG20019110, CTONG20019550, CTONG20020730, CTONG20021430, CTONG20024180, CTONG20024530, CTONG20025580, CTONG20027210, CTONG20028030, CTONG20028160, CTONG20028200, CTONG20029650, CTONG20037820, CTONG20047160, CTONG20055530, CTONG20064490, FEBRA20003770, FEBRA20004520, FEBRA20007400, FEBRA20007570, FEBRA20012940, FEBRA20021940, FEBRA20044120, HCASM10001150, HHDPC20004560, HLUNG20003140, HSYRA20002480, IMR3220009350, IMR3220012180, KIDNE20000850, KIDNE20002660, KIDNE20004220, KIDNE20005740, KIDNE20056760, KIDNE20060140, KIDNE20062480, MESAN20000920, MESAN20003370, NHNPC20002060, NT2NE10001850, NT2NE20000560, NT2NE20002140, NT2NE20003270, NT2NE20003840, NT2NE20014350, NT2NE20053710, NT2RI20006690, NT2RI20006710, NT2RI20016570, NT2RI20018660, NT2RI20025300, NT2RI20025410, NT2RI20030190, NT2RI20030510, NT2RI20036950, NT2RI20046060, NT2RI20053350, NT2RI20067350, NT2RI20075720, NT2RI20078790, NT2RI20083960, NT2RI20087140, NT2RI20094060, NT2RP60000350, NT2RP60001230, NT2RP70000760, NT2RP70004770, NT2RP70009060, NT2RP70011660, NT2RP70023760, NT2RP70023790, NT2RP70024500, NT2RP70026190, NT2RP70029820, NT2RP70036470, NT2RP70043730, NT2RP70061880, NT2RP70071770, NT2RP70076100, NT2RP70079750, NT2RP70084870, NT2RP70093730, OCBBF20013070, PEBLM20003950, PLACE60037450, PLACE60043120, PROST10003430, PROST10005260, PROST20032320, PROST20033020, PROST20056040, SKNMC10002510, SKNMC20000650, SKNMC20010570, SKNSH20003470, SMINT20000180, SYNOV20013740, TESTI10000230, TESTI10001680, TESTI20007840, TESTI20021490, TESTI20022230, TESTI20023690, TESTI20030050, TESTI20042950, TESTI20068720, TESTI20080200, TRACH20012890, BRACE20006980, BRACE20092740, BRAWH20006970, FCBBF10007600, FEBRA20062700, IMR3220016000, KIDNE20073280, MAMGL10000350, NT2NE20035690, NT2RI20056470, NT2RI20058110, NT2RI20084810, NT2RI20085260, NT2RP70015910, NT2RP70036290, NT2RP70036320, NT2RP70074220, NT2RP70075370, NTONG10000330, NTONG10000520, NTONG10001230, NTONG10001300, NTONG10001820, NTONG10002140, NTONG10002460, NTONG10002570, NTONG10002640, NTONG20002650, NTONG20003340, NTONG2003630, NTONG20004920, NTONG20005830, NTONG20008000, NTONG20008780, NTONG20009660, NTONG20009850, NTONG20011370, NTONG20012220, NTONG20014280, NTONG20015500, NTONG20016120, OCBBF20011240, OCBBF20015860, PROST10002200, SKMUS20016340, SKNMC20000970, STOMA20004820, SYNOV10001280, SYNOV20011440, THYMU10000830, TRACH20000790, TRACH20009260

These genes are involved in cancers.

Further, there is a method to search for genes involved in development and differentiation: the expression frequency analysis in which the expression levels of genes are compared between developing or differentiating tissues and/or cells and adult tissues and/or cells. The genes involved in tissue development and/or differentiation are genes participating in tissue construction and expression of function, and thus are useful genes, which are available for regenerative medicine aiming at convenient regeneration of injured tissues.

Search was carried out for the genes whose expression frequencies were different between developing and/or differentiating tissues and/or cells, and adult tissues and/or cells, by using the information of gene expression frequency based on the database of the nucleotide sequences of 770,546 clones shown above.

The result of comparative analysis of cDNA libraries derived from fetal brain (FCBBF, FEBRA or OCBBF) and adult brain (BRACE, BRALZ, BRAMY, BRAWH, BRCAN, BRCOC, BRHIP, BRSSN, BRSTN or BRTHA) showed that the genes whose expression levels were different between the two were the following clones (Tables 16 to 36).

BRACE20028960, BRACE20074010, BRACE20077080, BRACE20077980, BRACE20083800, BRACE20088570, BRAWH10000010, BRAWH10000020, BRAWH10000070, BRAWH10000370, BRAWH10000940, BRAWH10001300, BRAWH10001640, BRAWH10001680, BRAWH10001740, BRAWH10001800, BRAWH20000340, BRAWH20000340, BRAWH20000480, BRAWH20000930, BRAWH20001770, BRAWH20002480, BRAWH20003230, BRAWH20004430, BRAWH20004760, BRAWH20005030, BRAWH20005540, BRAWH20006330, BRAWH20006510, BRAWH20006970, BRAWH20008660, BRAWH20008920, BRAWH20009010, BRAWH20009440, BRAWH20009840, BRAWH20011030, BRAWH20011290, BRAWH20011660, BRAWH20012030, BRAWH20014180, BRAWH20014380, BRAWH20014610, BRAWH20015030, BRAWH20036890, BRAWH20038320, BRAWH20047310, BRAWH20059980, BRAWH20060440, BRAWH20064930, BRAWH20066220, BRAWH20069600, BRAWH20069890, BRAWH20074060, BRAWH20076050, BRAWH20089560, BRAWH20092270, BRAWH20092610, BRAWH20093600, BRAWH20094850, IMR3220013170, KIDNE20000850, KIDNE20004220, KIDNE20031850, KIDNE20050420, MAMGL10000350, NT2NE20001740, NT2RI20042840, NT2RI20086560, NT2RP70002590, NT2RP70065270, NT2RP70074220, NTONG10001820, PEBLM20001470, PLACE60032040, SKMUS10000140, SMINT20005450, TESTI20004350, TESTI20008830, TRACH20007800, TRACH20016070, UMVEN20001330, 3NB6910001730, 3NB6920002810, ADRGL20000740, BNGH410001370, BNGH410001980, BRACE10000200, BRACE10000730, BRACE10000930, BRACE20000770, BRACE20001000, BRACE20001410, BRACE20002800, BRACE20003320, BRACE20005050, BRACE20005250, BRACE20005450, BRACE20005650, BRACE20005650, BRACE20005770, BRACE20006980, BRACE20007180, BRACE20008850, BRACE20009880, BRACE20010650, BRACE20010700, BRACE20011170, BRACE20011430, BRACE20011430, BRACE20011880, BRACE20013400, BRACE20013520, BRACE20013740, BRACE20013750, BRACE20014230, BRACE20014530, BRACE20014550, BRACE20014770, BRACE20014920, BRACE20015080, BRACE20015430, BRACE20016730, BRACE20016920, BRACE20017370, BRACE20018550, BRACE20018590, BRACE20018650, BRACE20018980, BRACE20021510, BRACE20021760, BRACE20022020, BRACE20022270, BRACE20024090, BRACE20024090, BRACE20024310, BRACE20024680, BRACE20024950, BRACE20025900, BRACE20026350, BRACE20026850, BRACE20027360, BRACE20027520, BRACE20027550, BRACE20027720, BRACE20027920, BRACE20027960, BRACE20028120, BRACE20028600, BRACE20030780, BRACE20032850, BRACE20033190, BRACE20033980, BRACE20034310, BRACE20035160, BRACE20035940, BRACE20071380, BRACE20071530, BRACE20071970, BRACE20072010, BRACE20072320, BRACE20072810, BRACE20074470, BRACE20075020, BRACE20075270, BRACE20075380, BRACE20075630, BRACE20076210, BRACE20076460, BRACE20076630, BRACE20076850, BRACE20077610, BRACE20077640, BRACE20077670, BRACE20077840, BRACE20078680, BRACE20079020, BRACE20079530, BRACE20080970, BRACE20081140, BRACE20083850, BRACE20084430, BRACE20084880, BRACE20086530, BRACE20086550, BRACE20087080, BRACE20087540, BRACE20089600, BRACE20089990, BRACE20090140, BRACE20091880, BRACE20092120, BRACE20092750, BRACE20093070, BRACE20093110, BRACE20094370, CTONG20008270, CTONG20013200, CTONG20020730, CTONG20064490, HHDPC20000950, HHDPC20001150, HHDPC20004560, HSYRA10001780, HSYRA20008280, HSYRA20011530, IMR3210002660, IMR3220003020, IMR3220009350, KIDNE20003300, KIDNE20004970, KIDNE20005170, KIDNE20059370, KIDNE20068800, KIDNE20073280, LIVER20000370, MESAN20002670, NT2NE20005170, NT2NE20011560, NT2NE20013640, NT2NE20016970, NT2RI20006710, NT2RI20009740, NT2RI20022430, NT2RI20025300, NT2RI20028020, NT2RI20029260, NT2RI20030110, NT2RI20030510, NT2RI20040590, NT2RI20046060, NT2RI20049840, NT2RI20049850, NT2RI20056470, NT2RI20060720, NT2RI20062100, NT2RI20067350, NT2RI20068250, NT2RI20070840, NT2RI20070960, NT2RI20071480, NT2RI20072540, NT2RI20074980, NT2RI20085260, NT2RI20088120, NT2RI20090660, NT2RI20090830, NT2RP70013060, NT2RP70013350, NT2RP70023760, NT2RP70024500, NT2RP70030910, NT2RP70036320, NT2RP70036470, NT2RP70042330, NT2RP70054930, NT2RP70064900, NT2RP70071140, NT2RP70075370, NT2RP70076100, NT2RP70079750, NT2RP70081370, NT2RP70090120, NT2RP70091490, NT2RP70093730, NTONG20014280, NTONG20015500, PEBLM1

The result of comparative analysis of CDNA libraries derived from fetal heart (FEHRT) and adult heart (HEART) showed that the genes whose expression levels were different between the two were the following clones (Table 37).

KIDNE20062480, NT2RI20033040, NT2RP60000350, BGGI120010970, BRACE10000420, BRACE10001150, BRACE20003320, BRACE20077980, BRAWH10000370, BRAWH20000340, BRAWH20011660, BRAWH20014840, FEBRA20008740, FEBRA20072800, HEART20000350, HEART20000990, HEART20003090, HEART20004110, HEART20004480, HEART20004920, HEART20005060, HEART20005200, HEART20005680, HHDPC20001150, HLUNG20005010, HSYRA20014200, IMR3220013170, KIDNE20004970, NT2RI20000640, NT2RI20006710, NT2RI20015400, NT2RI20026540, NT2RI20037510, NT2RI20057230, NT2RI20064120, NT2RI20071330, NT2RI20071480, NT2RI20077540, NT2RI20084810, NT2RI20087910, NT2RP70000760, NT2RP70024500, NT2RP70029060, NTONG10001820, PLACE60012810, PLACE60043120, PROST20000530, SKMUS10000640, SKMUS20004580, SKMUS20015010, SMINT20002770, TESTI20033250, TESTI20074640, UMVEN20001330

The result of comparative analysis of CDNA libraries derived from fetal kidney (FEKID) and adult kidney (KIDNE) showed that the genes whose expression levels were different between the two were the following clones (Table 38).

3NB6920003300, 3NB6920009120, BGGI120010970, BRACE20004210, BRACE20005250, BRACE20011170, BRACE20020910, BRACE20026850, BRACE20080970, BRAWH20000340, BRAWH20006970, BRAWH20011660, FCBBF20001950, FEBRA20021940, FEBRA20043250, HLUNG10000640, IMR3220007420, IMR3220014350, KIDNE10000280, KIDNE10000500, KIDNE10001040, KIDNE10001430, KIDNE10001450, KIDNE10001520, KIDNE20000410, KIDNE20000510, KIDNE20000700, KIDNE20000850, KIDNE20001670, KIDNE20001920, KIDNE20002440, KIDNE20002450, KIDNE20002660, KIDNE20003150, KIDNE20003300, KIDNE20003490, KIDNE20003750, KIDNE20004030, KIDNE20004220, KIDNE20004970, KIDNE20005130, KIDNE20005170, KIDNE20005190, KIDNE20005740, KIDNE20031850, KIDNE20033050, KIDNE20033350, KIDNE20033570, KIDNE20033730, KIDNE20033770, KIDNE20037520, KIDNE20039410, KIDNE20039940, KIDNE20040340, KIDNE20040540, KIDNE20040840, KIDNE20042620, KIDNE20042940, KIDNE20042950, KIDNE20043440, KIDNE20045200, KIDNE20045340, KIDNE20045790, KIDNE20046810, KIDNE20048280, KIDNE20048640, KIDNE20048790, KIDNE20049810, KIDNE20050420, KIDNE20052960, KIDNE20053360, KIDNE20054000, KIDNE20054770, KIDNE20056290, KIDNE20056760, KIDNE20059080, KIDNE20059370, KIDNE20060140, KIDNE20060300, KIDNE20060530, KIDNE20060620, KIDNE20061490, KIDNE20062480, KIDNE20062990, KIDNE20063530, KIDNE20063760, KIDNE20066520, KIDNE20067600, KIDNE20067750, KIDNE20068800, KIDNE20070050, KIDNE20070770, KIDNE20071860, KIDNE20073280, KIDNE20073520, KIDNE20073560, KIDNE20074220, KIDNE20075690, KIDNE20078100, KIDNE20078110, LIVER10000790, MAMGL10000320, NB9N410000470, NT2NE20053710, NT2RI20006710, NT2RI20013420, NT2RI20016570, NT2RI20018460, NT2RI20025540, NT2RI20040590, NT2RI20065530, NT2RI20087490, NT2RI20087910, NT2RP60000350, NT2RP60001230, NT2RP70043730, NT2RP70069860, NT2RP70074220, OCBBF20014940, PLACE60014430, PLACE60020840, PLACE60043120, PROST10003430, SKNMC20000970, SKNSH20001510, SMINT10000160, SMINT20003960, SPLEN20000470, SPLEN20001340, SPLEN20003570, STOMA10000470, SYNOV10001280, TESTI10000700, TESTI20027070, TESTI20040310, TRACH10000300, TRACH20000790, TRACH20002500, TRACH20007800, KIDNE10000080, KIDNE20044110, NT2RI20033040, NT2RI20037510, NT2RP70065270, TRACH20012890

The result of comparative analysis of cDNA libraries derived from fetal lung (FELNG) and adult lung (HLUNG) showed that the genes whose expression levels were different between the two were the following clones (Table 39).

BNGH410001980, BRACE10000420, BRACE10001150, BRACE20014770, BRACE20018550, BRAWH20006970, BRAWH20014610, FEBRA20008810, FEBRA20015840, FEBRA20044120, HHDPC20001490, HLUNG10000240, HLUNG10000300, HLUNG10000370, HLUNG10000640, HLUNG10000760, HLUNG10000990, HLUNG10001050, HLUNG10001100, HLUNG20000680, HLUNG20001160, HLUNG20001250, HLUNG20001420, HLUNG20001760, HLUNG20002550, HLUNG20003140, HLUNG20004120, HLUNG20004800, HLUNG20005010, HSYRA20014200, KIDNE20002660, KIDNE20033050, NT2NE20014350, NT2RI20016570, NT2RI20026540, NT2RI20051500, NT2RI20064120, NT2RI20083960, NT2RI20085260, NT2RI20087490, NT2RP70009060, NT2RP70011660, NT2RP70029060, NT2RP70055020, NT2RP70074220, NT2RP70076100, NTONG10002460, NTONG20008000, PLACE60043120, SKMUS20016340, SKNMC20005930, SMINT20000180, SMINT20002390, SMINT20002770, SMINT20003960, STOMA10000470, STOMA20001880, SYNOV20013740, TESTI20036250, TESTI20080200, TRACH20004610, BRACE20004210, IMR3220007420

These genes are involved in regeneration of tissues and/or cells.

EXAMPLE 8

Expression Frequency Analysis by PCR

Specific PCR primers were prepared based on the full-length nucleotide sequences, and the expression frequency was analyzed by the ATAC-PCR method (Adaptor-tagged competitive PCR method: Nucleic Acids Research 1997, 25(22): 4694–4696; "DNA Micro-array and Advanced PCR Techniques", Cell Technology, supplement, Eds., Muramatsu and Nawa (Shujunsha, 2000): 104–112). Inflammation-related genes can be identified by revealing the genes whose expression levels are altered depending on the presence of an inflammation-inducing factor. Then, by using THP-1 cell line, which is a cell line of monocyte line, and TNF-α and LPS, both of which are inflammation-inducing factors, suitable for this system, the genes whose expression levels are altered depending on the presence of the factors were searched for by the system.

THP-1 cell line (purchased from DAINIPPON PHARMACEUTICAL) was cultured to be confluent in RPMI1640 medium (sigma) containing 5% fetal calf serum (GIBCO BRL). Then, the medium was changed with the medium containing 10 ng/ml TNF-α (human recombinant TNF-α; Pharmacia Biotech) or 1 μg/mL LPS (Lipopolysaccharides; sigma), and the culture was continued at 37° C. under 5% CO$_2$. After three hours, the cells were harvested, and total RNA was extracted from them by using ISOGEN reagent (Nippon Gene). The extraction was carried out according to the method in the document attached to ISOGEN reagent. In addition, total RNA was also extracted from the cells cultured without stimulation of TNF-α or LPS.

The genes involved in the onset of gastritis and gastroduodenal ulcer induced by the infection of *Helicobacter pylori* to the epithelia of stomach can be identified by revealing the genes whose expression levels are altered depending on co-culturing the cells with *Helicobacter pylori*. Then, by using co-culture of a gastric cancer cell line with *Helicobacter pylori*, suitable for this system, the genes whose expression levels are altered depending on the presence of *Helicobacter pylori*, were searched for by the system.

A gastric cancer cell line MKN45 (provided by the Cell Bank, RIKEN GENE BANK, The Institute of Physical and Chemical Research) was cultured to be confluent in RPMI1640 medium (sigma) containing 10% fetal calf serum (GIBCO BRL). Then, the medium was changed with the medium containing 100-fold excess (in terms of the number of cells or the number of colonies) of *Helicobacter pylori* (TN2 strain: provided by Prof. Omata, Faculty of Medicine, The University of Tokyo), as compared with the number of the cancer cells. The culture was continued at 37° C. under 5% CO$_2$. After three hours, the cells were harvested, and total RNA was extracted from them by using ISOGEN reagent (Nippon Gene) The extraction was carried out according to the method in the document attached to ISOGEN reagent. In addition, total RNA was also extracted from the cells cultured without *Helicobacter pylori*.

The analysis by the ATAC-PCR method was carried out basically according to "DNA Micro-array and Advanced PCR Techniques", Cell Technology, supplement (Genome Science Series 1, Eds., Muramatsu and Nawa (Shujunsha, 2000): 104–112). Adapter ligation to the internal standard sample (sample to make the calibration curve for the clone of interest) and test sample was carried out in the two separate reaction systems indicated below. The combination of 6 types of adapters (AD-1, AD-2, AD-3, AD-4, AD-5 and AD-6: see the sequences indicated below) and the samples are as follows.

Reaction System A
AD1; internal standard, 10-fold
AD2; THP-1 cells, unstimulated
AD3; internal standard, 3-fold
AD4; THP-1 cells, TNF-α stimulation
AD5; THP-1 cells, LPS stimulation
AD6; internal standard, 1-fold
Reaction System B
AD1; internal standard, 1-fold
AD2; MKN45 cells, unstimulated
AD3; internal standard, 3-fold
AD4; MKN45 cells, co-cultured with *Helicobacter pylori*
AD5; internal standard, 10-fold
Adapter sequences:

```
AD1;                                         SEQ ID NO: 3283
//5'-GTACATATTGTCGTTAGAACGCG-3'

SEQ ID NO: 3284
//3'-CATGTATAACAGCAATCTTGCGCCTAG-5'
```

-continued

```
AD2;                                         SEQ ID NO: 3285
//5'-GTACATATTGTCGTTAGAACGCGACT-3'

SEQ ID NO: 3286
//3'-CATGTATAACAGCAATCTTGCGCTGACTAG-5'

AD3;                                         SEQ ID NO: 3287
//5'-GTACATATTGTCGTTAGAACGCGCATACT-3'

SEQ ID NO: 3288
//3'-CATGTATAACAGCAATCTTGCGCGTATGACTAG-5'

AD4;                                         SEQ ID NO: 3289
//5'-GTACATATTGTCGTTAGAACGCGATCCATACT-3'

SEQ ID NO: 3290
//3'-CATGTATAACAGCAATCTTGCGCTAGGTATGACTAG-5'

AD5;                                         SEQ ID NO: 3291
//5'-GTACATATTGTCGTTAGAACGCGTCAATCCATACT-3'

SEQ ID NO: 3292
//3'-CATGTATAACAGCAATCTTGCGCAGTTAGGTATGACTAG-5'

AD6;                                         SEQ ID NO: 3293
//5'-GTACATATTGTCGTTAGAACGCGTACTCAATCCATACT-3'

SEQ ID NO: 3294
//3'-CATGTATAACAGCAATCTTGCGCATGAGTTAGGTATGACTAG-5'
```

The internal standard sample used for this assay was a mixture of total RNAs of THP-1 Control, MKN45 Control, NT2 (Stratagene; catalog No. 204101). RNA preparation from the culture cells was carried out according to the standard method.

The sequences of primers specific to the genes and the names of clones of interest in the analysis are as follows. The gene specific primers were designed to produce the PCR products of 70 to 200 bp, which are derived from the adapter-containing CDNA. The sequence of adapter-specific primer (labeled with fluorescence (FAM)) used in the competitive PCR was GTACATATTGTCGTTAGAACGC (22 nucleotides; SEQ ID NO: 3295). PCR was basically carried out with a cycling profile of preheating at 94° C. for 3 minutes, and 30 cycles of denaturation at 94° C. for 30 seconds/annealing at 50° C. for 60 seconds/extension at 72° C. for 90 seconds; in some cases, merely the annealing temperature was changed.

The Nucleotide Sequences of Clone Specific Primers Used in the Experiments

Clone name, primer sequence and SEQ ID NO are indicated below in this order. Each is demarcated by a double slash mark (//).

```
                                             SEQ ID NO: 3296
     3NB6920000290//CTCCTCCAGCAGAACTTG//

SEQ ID NO: 3297
     ADRGL10000180//TTTAGAGCTGATTCCCCATT//

SEQ ID NO: 3298
     BNGH410001370//TAAAAGCAGGAAATTGTAAA//

SEQ ID NO: 3299
     BRACE10001590//ATATGGACAAAGGACCAATT//

SEQ ID NO: 3300
     BRACE10001690//AGGACTAGATTCACTGCTTA//
```

-continued

BRACE20010650//CAACTCTCAACACCACAATC// SEQ ID NO: 3301

BRACE20013400//CTACTCAAGGACAGCCACAC// SEQ ID NO: 3302

BRACE20030780//AGATAGAGGCTTGCTGGTGT// SEQ ID NO: 3303

BRACE20034490//CCTTATGTCAAACTGCGATT// SEQ ID NO: 3304

BRACE20077640//TTTGCCTTATTCATTGGTTG// SEQ ID NO: 3305

BRACE20079530//GTAATATCACCCCACAGAGG// SEQ ID NO: 3306

BRACE20083850//TATCATCTTTTGGGGCTTTG// SEQ ID NO: 3307

BRACE20091880//AATAAGCCAGTTGCATCCTC// SEQ ID NO: 3308

BRAWH10001620//TCTCTCATCTCCAAACATGC// SEQ ID NO: 3309

BRAWH20004430//TGAATTGAAAGAGACACACT// SEQ ID NO: 3310

FCBBF10006180//CTTAATCCAGTTCATCAGCT// SEQ ID NO: 3311

FEBRA20003780//TTTTGAGACAGAGTTTCGCT// SEQ ID NO: 3312

FEBRA20006800//ATGTTTTACGATTGCCTTTG// SEQ ID NO: 3313

FEBRA20008810//GAAGCATCTTTGGTGTACTA// SEQ ID NO: 3314

FEBRA20012940//TGTCCCTGGAAAGTAATATA// SEQ ID NO: 3315

FEBRA20015840//AACACAGTAGCCAGAACCAG// SEQ ID NO: 3316

HCASM10000610//AAGAGCCTACTACACGCCAG// SEQ ID NO: 3317

HEART20000350//TTTAAGAGCACACAGAAGTC// SEQ ID NO: 3318

HEART20004480//ATTACTGGTGTGGAGTGGGT// SEQ ID NO: 3319

HEART20005060//ACTCTGCCTTCACTTTCCTT// SEQ ID NO: 3320

HHDPC20000950//GATAAAGGATACAGCCAAAA// SEQ ID NO: 3321

HLUNG10000370//ATCATGGTCGTTACAGAATT// SEQ ID NO: 3322

HLUNG20001160//ACTGCCTTCAATCTCAGGTT// SEQ ID NO: 3323

HLUNG20001760//ATCACTGCCAATTTCACAAA// SEQ ID NO: 3324

HSYRA20003470//CCACCGAGTTCTGTTG// SEQ ID NO: 3325

HSYRA20013320//GTCATGGCCACAGTTGTATC// SEQ ID NO: 3326

IMR3210001580//GATAAAGGATACACCCAAAA// SEQ ID NO: 3327

IMR3210002660//CCCAAAATGTGTATTATTCA// SEQ ID NO: 3328

INR3220008380//TTCGGCAATAATCTTCTCTT// SEQ ID NO: 3329

IMR3220008590//CCACCAACACTTAGACATCA// SEQ ID NO: 3330

KIDNE10001520//GAATTATAGGTGCACAACAC// SEQ ID NO: 3331

KIDNE20000850//TCTTCTAGTGGAAGAGGTTTA// SEQ ID NO: 3332

KIDNE20003490//TATCTGAAAATGTGTTTGGT// SEQ ID NO: 3333

KIDNE20005170//ACTCCTGGCTTTCTATTTCC// SEQ ID NO: 3334

KIDNE20033730//GACAGTCTCGCTGTATCTCC// SEQ ID NO: 3335

KIDNE20040540//ACATCCAGTACACCTTCTCC// SEQ ID NO: 3336

KIDNE20050420//GTCGAAAGTGTTGCTCCTAG// SEQ ID NO: 3337

KIDNE20061490//TCATAGCTGAGGGGTTAAGT// SEQ ID NO: 3338

KIDNE20062990//ATAGCTCTTGTTTCAGTGTG// SEQ ID NO: 3339

LIVER20000330//AAGCATGTGGGAGTTATTTA// SEQ ID NO: 3340

NT2NE10001630//CTTGAGAGTCCAGGTTTCCT// SEQ ID NO: 3341

NT2NE10001850//CCCATAAAGAATAGAAGCTC// SEQ ID NO: 3342

NT2NE20003920//CTCATGGGCTAAGTCTATT// SEQ ID NO: 3343

NT2NE20005500//TCAAAGTCCAGGATAGCATT// SEQ ID NO: 3344

NT2RI20009740//ACTGATTTGGTTCTGCGATT// SEQ ID NO: 3345

NT2RI20014500//CTTACTTCGAGTTCTAGCAC// SEQ ID NO: 3346

NT2RI20016570//TGCTGCTCATGTTAAACTTG// SEQ ID NO: 3347

NT2RI20018660//AAACATCATCTCTTCCTTGG// SEQ ID NO: 3348

NT2RI20021520//GCTGAAGAGAACAATAAGTC// SEQ ID NO: 3349

NT2RI20050870//GACAGAGTAGTGGGGCATCT// SEQ ID NO: 3350

NT2RI20053350//TTCAGCAGGTAGACAACATC// SEQ ID NO: 3351

NT2RI20070480//CCTCTCTTTCAGTTGAGCAT// SEQ ID NO: 3352

NT2RI20073030//GGGCTTGTTTTACGC// SEQ ID NO: 3353

-continued

NT2RI20078270//CCTAGGCAGTAACATGAAAA// SEQ ID NO: 3354

NT2RI20078790//GCAGACAGGTACAGCTGAGT// SEQ ID NO: 3355

NT2RI20083360//TTATTTTAGTTACCTTGGCA// SEQ ID NO: 3356

NT2RP60000080//ACTGTAAATCTCCTTGCCTT// SEQ ID NO: 3357

NT2RP60000390//GAGTTTGGGGACAGTCAAGT// SEQ ID NO: 3358

NT2RP60000590//AAATGCAAAATTGCTGAGAT// SEQ ID NO: 3359

NTONG10000980//TTCAGCAGGTAGACAACATC// SEQ ID NO: 3360

NTONG10002570//GTCGCTGAAATTTGCTTCTT// SEQ ID NO: 3361

PLACE60020160//CCATATCCACTTTCATCATC// SEQ ID NO: 3362

PLACE60026990//CAAGAAACTGACAATCACGG// SEQ ID NO: 3363

PLACE60047380//AAGGAGTTGACATTTTGCTG// SEQ ID NO: 3364

PUAEN10003220//TTTTCAGAGGGCTTTGTGTT// SEQ ID NO: 3365

SKNMC10000290//ATAACTGAACCCATGGAAAG// SEQ ID NO: 3366

SKNMC10001590//ACATCCAGTACACCTTCTCC// SEQ ID NO: 3367

SKNMC20000650//GCACTAGGAGACTGTCAAAA// SEQ ID NO: 3368

STOMA20002570//GGTATCTTGGAGCTCCTCAG// SEQ ID NO: 3369

STOMA20002890//GTCAGCATCTACTCTGGGTC// SEQ ID NO: 3370

SYNOV20001770//AAGAAATAAACACACGAAAA// SEQ ID NO: 3371

TESTI10000230//AAATGCAAAATTGCTGAGAT// SEQ ID NO: 3372

TESTI10000550//CAGAACAGTCCTCATACCTC// SEQ ID NO: 3373

TESTI20011340//AAAGTACAGCAGAAGATGGG// SEQ ID NO: 3374

THYMU10005580//AACAGCTTCTTCATCACAGT// SEQ ID NO: 3375

TRACH10000630//ATAGAGGAAGGTGGCAACTG// SEQ ID NO: 3376

TRACH20001960//CTCTTTTCCATCACATTCCC// SEQ ID NO: 3377

UMVEN10001220//CCAAGTTCTCATTCCACATT// SEQ ID NO: 3378

UMVEN20001330//AGCTAACAAGGTTTTGACAC// SEQ ID NO: 3379

UTERU20004850//AGACTGGGTCTTGCCATACT// SEQ ID NO: 3380

The result of expression frequency analysis is shown in Table 40. The clones not shown in the table contain clones whose expression levels could not be measured because the levels were too low or the sizes of the PCR products were different from the expected. It was confirmed that the expression levels of TNF-α, IL-1, and IL-8 genes used as positive control genes were elevated.

The result obtained by the search for the genes whose expression levels were altered depending on the presence of TNF-α or LPS in culturing THP-1 cell, which is a human monocyte cell line, showed that the clones whose expression levels were elevated by twofold or more depending on the TNF-α stimulation (the clones whose expression levels were 0.1 or lower both before and after the stimulation were excluded), were ADRGL10000180, BRACE20030780, BRACE20077640, BRACE20083850, BRAWH20004430, FCBBF10006180, FEBRA20003780, FEBRA20006800, FEBRA20012940, FEBRA20015840, HEART20004480, HLUNG10000370, HLUNG20001160, HSYRA20013320, IMR3220008380, KIDNE10001520, KIDNE20040540, KIDNE20061490, KIDNE20062990, NT2NE10001630, NT2NE20003920, NT2NE20005500, NT2RI20014500, NT2RI20016570, NT2RI20078270, NT2RI20083360, NTONG10002570, PUAEN10003220, SKNMC10000290, STOMA20002570, TESTI20011340, UTERU20004850.

Further, the clones whose expression levels were elevated by twofold or more depending on the LPS stimulation (the clones whose expression levels were 0.1 or lower both before and after the stimulation were excluded), were FCBBF10006180, FEBRA20015840, HLUNG10000370, HLUNG20001160, HSYRA20013320, KIDNE20040540, KIDNE20061490, NT2NE10001630, NT2NE20003920, NT2NE20005500, NT2RI20014500, NT2RI20016570, NT2RI20078270, NTONG10002570, PUAEN10003220, STOMA20002570, TESTI20011340. These genes whose expression levels were elevated by LPS stimulation, were all up-regulated by the TNF-α stimulation.

On the other hand, with respect to the genes whose expression is suppressed, in particular cases where the expression levels were relatively high in the unstimulated cells (the relative value were 1 or higher), the clones whose expression levels were decreased by twofold or more by the TNF-α stimulation, were BRACE20013400, BRACE20091880, HEART20005060, HLUNG20001760, IMR3220008590, NT2NE10001850, NT2RI20018660, NT2RI20053350, NT2RI20070480, PLACE60047380, STOMA20002890, SYNOV20001770, TRACH20001960. Further, when the levels were normalized by using the ratio of the expression level of β-actin widely used in data normalization for gene expression level, the clones whose expression levels were decreased by tenfold or more depending on the LPS stimulation, were BRACE20013400, BRACE20091880, HEART20005060, HLUNG20001760, NT2RI20070480, UMVEN20001330. Among the genes whose expression levels were decreased by TNF-α stimulation, the genes whose expression levels were also decreased by the LPS stimulation were BRACE20013400, BRACE20091880, HEART20005060, HLUNG20001760, NT2RI20070480.

These clones were thus revealed to be involved in the inflammation reaction induced by TNF-α or LPS.

The result obtained by the search for the genes whose expression levels were altered depending on co-culturing gastric cancer cell line MKN45 with *Helicobacter pylori*, showed that the clones whose expression levels were elevated by twofold or more depending on the presence of *Helicobacter pylori* (the clones whose expression levels were 0.1 or lower both before and after the stimulation were excluded), were BRACE10001590, BRACE20079530, BRAWH10001620, FEBRA20006800, KIDNE20003490, KIDNE20040540, KIDNE20050420, NT2NE10001850, STOMA20002890, SYNOV20001770, TESTI10000550, UTERU20004850. Of the clones, FEBRA20006800, KIDNE20040540 and UTERU20004850 were also up-regulated by TNF-α stimulation in the human monocyte cell line THP-1.

On the other hand, with respect to the genes whose expression is suppressed, in particular cases where the expression levels were relatively high in the unstimulated cells in (the relative value were 1 or higher), when the levels were normalized by using the ratio of the expression level of β-actin widely used in data normalization for gene expression level, the clones whose expression levels were decreased by fivefold or more in the presence of *Helicobacter pylori*, were BRACE20034490, BRACE20077640, BRACE20083850, KIDNE20005170, LIVER20000330, NT2RP60000390, NTONG10000980, UMVEN20001330.

These clones are involved in gastritis or gastroduodenal ulcer.

TABLE 3

| Clone ID | CD34C | D30ST | D60ST | D90ST |
|---|---|---|---|---|
| KIDNE20062480 | 0 | 4.908 | 0 | 5.748 |
| NT2RI20016570 | 0 | 7.035 | 0 | 8.24 |
| PLACE60020840 | 0 | 8.776 | 0 | 20.558 |
| 3NB6920002810 | 0 | 0 | 0 | 4.74 |
| BRACE20035270 | 0 | 0 | 0 | 33.245 |
| BRAWH20000340 | 0 | 0 | 0 | 40.521 |
| FEBRA20062700 | 0 | 0 | 0 | 35.533 |
| HSYRA20011030 | 0 | 0 | 0 | 9.617 |
| NT2RP70030910 | 0 | 0 | 0 | 39.804 |
| OCBBF20011240 | 0 | 0 | 0 | 44.145 |
| PLACE60043120 | 0 | 0 | 0 | 15.442 |
| SYNOV20011440 | 0 | 0 | 0 | 15.55 |
| HCASM10001150 | 0 | 0 | 40.145 | 0 |
| IMR3220016000 | 0 | 0 | 13.886 | 0 |
| NT2RI20082210 | 0 | 0 | 79.241 | 0 |
| D30ST20001840 | 0 | 100 | 0 | 0 |
| FEBRA20012940 | 0 | 37.059 | 0 | 0 |
| FEBRA20021910 | 0 | 63.399 | 0 | 0 |
| IMR3220002230 | 0 | 10.991 | 0 | 0 |
| IMR3220012180 | 0 | 18.197 | 0 | 0 |
| NT2RI20000640 | 0 | 9.996 | 0 | 0 |
| NT2RI20010910 | 0 | 46.971 | 0 | 0 |
| NT2RI20058110 | 0 | 20.306 | 0 | 0 |
| NT2RP60000350 | 0 | 4.385 | 0 | 0 |
| NT2RP70011660 | 0 | 8.936 | 0 | 0 |
| PEBLM20003950 | 0 | 14.226 | 0 | 0 |
| PLACE60049310 | 0 | 68.294 | 0 | 0 |
| PROST20062600 | 0 | 66.053 | 0 | 0 |
| TESTI20007840 | 0 | 7.864 | 0 | 0 |
| TESTI20040310 | 0 | 8.52 | 0 | 0 |
| TESTI20080200 | 0 | 4.493 | 0 | 0 |
| THYMU10003590 | 0 | 9.698 | 0 | 0 |
| TRACH10000630 | 0 | 34.338 | 0 | 0 |
| TRACH20007800 | 0 | 18.508 | 0 | 0 |
| CD34C20000510 | 100 | 0 | 0 | 0 |
| HSYRA20016210 | 5.607 | 0 | 0 | 3.6 |
| KIDNE20004030 | 66.99 | 0 | 0 | 0 |
| KIDNE20073280 | 54.663 | 0 | 0 | 0 |
| NT2RP70055020 | 58.521 | 0 | 0 | 0 |
| PLACE60043960 | 58.654 | 16.078 | 0 | 0 |
| SKMUS10000220 | 57.743 | 0 | 0 | 0 |

TABLE 4

| Clone ID | NT2RM | NT2RP | NT2RI | NT2NE |
|---|---|---|---|---|
| SKNMC20000970 | 19 | 2.312 | 0.784 | 1.188 |
| 3NB6920009120 | 0 | 2.916 | 1.978 | 8.993 |
| BRAWH20006970 | 0 | 4.004 | 2.717 | 4.117 |
| KIDNE20062480 | 0 | 1.503 | 7.137 | 3.09 |
| NHNPC20002060 | 0 | 1.674 | 1.136 | 5.165 |
| NT2NE20053710 | 0 | 7.977 | 0.773 | 2.343 |
| NT2RI20000640 | 0 | 1.53 | 1.038 | 3.147 |
| NT2RI20004210 | 0 | 29.541 | 40.087 | 30.373 |
| NT2RI20006710 | 0 | 2.481 | 1.683 | 2.551 |
| NT2RI20009740 | 0 | 13.985 | 9.489 | 14.379 |
| NT2RI20013420 | 0 | 4.074 | 1.382 | 2.094 |
| NT2RI20013850 | 0 | 6.297 | 4.273 | 2.158 |
| NT2RI20014100 | 0 | 53.957 | 18.305 | 27.738 |
| NT2RI20025410 | 0 | 17.546 | 11.905 | 18.04 |
| NT2RI20033040 | 0 | 3.342 | 3.401 | 3.436 |
| NT2RI20035560 | 0 | 28.514 | 3.869 | 5.864 |
| NT2RI20036950 | 0 | 4.691 | 9.549 | 4.823 |
| NT2RI20051500 | 0 | 3.392 | 9.205 | 10.462 |
| NT2RI20053350 | 0 | 2.329 | 1.581 | 2.395 |
| NT2RI20057230 | 0 | 2.418 | 1.641 | 7.458 |
| NT2RI20071330 | 0 | 13.599 | 9.227 | 6.991 |
| NT2RI20075720 | 0 | 4.321 | 2.932 | 4.443 |
| NT2RI20083960 | 0 | 8.389 | 5.692 | 8.625 |
| NT2RI20087910 | 0 | 5.711 | 1.938 | 2.936 |
| NT2RI20090650 | 0 | 2.967 | 6.039 | 3.051 |
| NT2RI20094060 | 0 | 26.699 | 18.115 | 13.726 |
| NT2RP60000350 | 0 | 5.37 | 4.554 | 4.141 |
| NT2RP70000760 | 0 | 4.602 | 3.122 | 4.732 |
| NT2RP70036800 | 0 | 6.556 | 8.897 | 6.741 |
| NT2RP70071770 | 0 | 18.93 | 6.422 | 9.732 |
| NT2RP70074220 | 0 | 4.004 | 2.717 | 4.117 |
| TESTI20007840 | 0 | 19.261 | 3.267 | 4.951 |
| TESTI20080200 | 0 | 1.375 | 1.867 | 1.414 |
| 3NB6920002810 | 0 | 1.239 | 0.841 | 0 |
| 3NB6920005450 | 0 | 7.198 | 4.884 | 0 |
| HSYRA20015740 | 0 | 8.09 | 5.489 | 0 |
| HSYRA20016210 | 0 | 2.353 | 1.277 | 0 |
| IMR3220016000 | 0 | 1.458 | 0.989 | 0 |
| KIDNE20060140 | 0 | 14.005 | 9.502 | 0 |
| NT2RI20014490 | 0 | 29.632 | 70.368 | 0 |
| NT2RI20015950 | 0 | 59.577 | 40.423 | 0 |
| NT2RI20022520 | 0 | 59.577 | 40.423 | 0 |
| NT2RI20025170 | 0 | 59.577 | 40.423 | 0 |
| NT2RI20025540 | 0 | 5.634 | 3.823 | 0 |
| NT2RI20030510 | 0 | 15.012 | 10.186 | 0 |
| NT2RI20040590 | 0 | 13.827 | 9.381 | 0 |
| NT2RI20046060 | 0 | 9.661 | 13.11 | 0 |
| NT2RI20053680 | 0 | 3.443 | 4.672 | 0 |
| NT2RI20058510 | 0 | 12.325 | 16.726 | 0 |
| NT2RI20066820 | 0 | 32.943 | 67.057 | 0 |
| NT2RI20067030 | 0 | 59.577 | 40.423 | 0 |
| NT2RI20074980 | 0 | 6.002 | 24.433 | 0 |
| NT2RI20075890 | 0 | 12.002 | 8.144 | 0 |
| NT2RI20078840 | 0 | 22.336 | 7.578 | 0 |
| NT2RI20084810 | 0 | 12.646 | 12.87 | 0 |
| NT2RI20089420 | 0 | 17.837 | 18.153 | 0 |
| NT2RP70002380 | 0 | 44.979 | 15.259 | 0 |
| NT2RP70023790 | 0 | 2.283 | 1.549 | 0 |
| NT2RP70029820 | 0 | 15.713 | 10.661 | 0 |
| NT2RP70049150 | 0 | 59.577 | 40.423 | 0 |
| NT2RP70055020 | 0 | 4.911 | 3.332 | 0 |
| NT2RP70065270 | 0 | 1.664 | 1.129 | 0 |
| NT2RP70069860 | 0 | 10.864 | 7.371 | 0 |
| NT2RP70075370 | 0 | 7.229 | 1.635 | 0 |
| NT2RP70079750 | 0 | 3.104 | 2.106 | 0 |
| NT2RP70092590 | 0 | 17.381 | 11.793 | 0 |
| OCBBF20000130 | 0 | 7.346 | 19.936 | 0 |
| PLACE60043970 | 0 | 12.827 | 4.352 | 0 |
| TESTI20053960 | 0 | 24.609 | 5.566 | 0 |
| BNGH420004740 | 0 | 2.789 | 0 | 2.867 |
| HSYRA20002480 | 0 | 2.789 | 0 | 2.867 |
| NT2NE10000730 | 0 | 24.483 | 0 | 75.517 |
| NT2NE20000560 | 0 | 4.458 | 0 | 4.584 |
| NT2NE20003270 | 0 | 28.131 | 0 | 14.462 |
| NT2NE20008090 | 0 | 34.048 | 0 | 17.504 |
| NT2NE20014030 | 0 | 17.216 | 0 | 35.403 |
| NT2RP60000720 | 0 | 5.865 | 0 | 3.015 |

TABLE 4-continued

| Clone ID | NT2RM | NT2RP | NT2RI | NT2NE |
|---|---|---|---|---|
| NT2RP60001090 | 0 | 3.47 | 0 | 3.568 |
| NT2RP70004770 | 0 | 22.083 | 0 | 11.353 |
| NT2RP70010800 | 0 | 59.331 | 0 | 40.669 |
| NT2RP70011660 | 0 | 5.472 | 0 | 2.813 |
| NT2RP70028750 | 0 | 7.823 | 0 | 1.609 |
| NT2RP70029060 | 0 | 3.063 | 0 | 9.449 |
| NT2RP70030550 | 0 | 49.305 | 0 | 50.695 |
| NT2RP70032030 | 0 | 8.843 | 0 | 4.546 |
| NT2RP70036320 | 0 | 8.861 | 0 | 9.111 |
| NT2RP70064900 | 0 | 32.803 | 0 | 33.727 |
| NT2RP70093220 | 0 | 32.957 | 0 | 33.885 |
| NT2RP70093730 | 0 | 29.95 | 0 | 30.794 |
| SYNOV20013740 | 0 | 11.184 | 0 | 11.499 |
| TESTI20021490 | 0 | 20.062 | 0 | 6.876 |
| TRACH20004720 | 0 | 5.169 | 0 | 2.657 |
| TRACH20007800 | 0 | 11.333 | 0 | 11.652 |
| 3NB6920003300 | 0 | 0 | 0.71 | 1.076 |
| BRACE10000200 | 0 | 0 | 18.865 | 28.588 |
| BRACE20018550 | 0 | 0 | 16.357 | 12.393 |
| FEBRA20008740 | 0 | 0 | 2.493 | 3.778 |
| FEBRA20074580 | 0 | 0 | 23.056 | 34.938 |
| FEBRA20076220 | 0 | 0 | 6.122 | 2.319 |
| KIDNE20073520 | 0 | 0 | 4.038 | 3.06 |
| MAMGL10000320 | 0 | 0 | 0.39 | 0.591 |
| NT2NE20002140 | 0 | 0 | 7.614 | 11.538 |
| NT2NE20006360 | 0 | 0 | 18.047 | 54.696 |
| NT2NE20007870 | 0 | 0 | 3.883 | 11.767 |
| NT2NE20009800 | 0 | 0 | 39.756 | 60.244 |
| NT2NE20035690 | 0 | 0 | 14.209 | 10.766 |
| NT2RI20002940 | 0 | 0 | 12.546 | 19.012 |
| NT2RI20014500 | 0 | 0 | 3.454 | 5.235 |
| NT2RI20016210 | 0 | 0 | 21.272 | 16.117 |
| NT2RI20029260 | 0 | 0 | 18.069 | 54.761 |
| NT2RI20037510 | 0 | 0 | 3.361 | 5.094 |
| NT2RI20055640 | 0 | 0 | 19.702 | 29.855 |
| NT2RI20064120 | 0 | 0 | 2.899 | 4.393 |
| NT2RI20074390 | 0 | 0 | 39.756 | 60.244 |
| NT2RI20077230 | 0 | 0 | 14.643 | 11.094 |
| NT2RI20090660 | 0 | 0 | 5.676 | 17.202 |
| PLACE60040050 | 0 | 0 | 3.883 | 11.767 |
| TRACH20012890 | 0 | 0 | 4.391 | 2.218 |
| 3NB6910001730 | 0 | 0 | 0 | 2.934 |
| BRACE10001150 | 0 | 0 | 0 | 1.941 |
| BRACE20011170 | 0 | 0 | 0 | 3.434 |
| BRACE20020910 | 0 | 0 | 0 | 19.866 |
| BRACE20035270 | 0 | 0 | 0 | 8.935 |
| BRAWH20005220 | 0 | 0 | 0 | 12.892 |
| FEBRA20003970 | 0 | 0 | 0 | 36.013 |
| FEBRA20012450 | 0 | 0 | 0 | 13.643 |
| HLUNG20003140 | 0 | 0 | 0 | 13.547 |
| IMR3220009350 | 0 | 0 | 0 | 4.198 |
| IMR3220013170 | 0 | 0 | 0 | 4.4 |
| IMR3220013320 | 0 | 0 | 0 | 2.646 |
| IMR3220014350 | 0 | 0 | 0 | 4.254 |
| NT2NE10000040 | 0 | 0 | 0 | 49.427 |
| NT2NE10000140 | 0 | 0 | 0 | 100 |
| NT2NE10000180 | 0 | 0 | 0 | 9.321 |
| NT2NE10000230 | 0 | 0 | 0 | 100 |
| NT2NE10000630 | 0 | 0 | 0 | 100 |
| NT2NE10000830 | 0 | 0 | 0 | 100 |
| NT2NE10001200 | 0 | 0 | 0 | 100 |
| NT2NE10001630 | 0 | 0 | 0 | 100 |
| NT2NE10001850 | 0 | 0 | 0 | 60.858 |
| NT2NE20000380 | 0 | 0 | 0 | 64.993 |
| NT2NE20000640 | 0 | 0 | 0 | 100 |
| NT2NE20001740 | 0 | 0 | 0 | 11.757 |
| NT2NE20002590 | 0 | 0 | 0 | 30.217 |
| NT2NE20002990 | 0 | 0 | 0 | 100 |
| NT2NE20003690 | 0 | 0 | 0 | 100 |
| NT2NE20003840 | 0 | 0 | 0 | 3.017 |
| NT2NE20003920 | 0 | 0 | 0 | 9.486 |
| NT2NE20004550 | 0 | 0 | 0 | 100 |
| NT2NE20004700 | 0 | 0 | 0 | 33.507 |
| NT2NE20005170 | 0 | 0 | 0 | 61.289 |
| NT2NE20005360 | 0 | 0 | 0 | 100 |
| NT2NE20005500 | 0 | 0 | 0 | 100 |
| NT2NE20005860 | 0 | 0 | 0 | 100 |
| NT2NE20006580 | 0 | 0 | 0 | 100 |
| NT2NE20007060 | 0 | 0 | 0 | 100 |
| NT2NE20007630 | 0 | 0 | 0 | 15.634 |
| NT2NE20008020 | 0 | 0 | 0 | 100 |
| NT2NE20011560 | 0 | 0 | 0 | 40.371 |
| NT2NE20012470 | 0 | 0 | 0 | 100 |
| NT2NE20013240 | 0 | 0 | 0 | 100 |
| NT2NE20013370 | 0 | 0 | 0 | 100 |
| NT2NE20013640 | 0 | 0 | 0 | 49.334 |
| NT2NE20013720 | 0 | 0 | 0 | 100 |
| NT2NE20014280 | 0 | 0 | 0 | 100 |
| NT2NE20014350 | 0 | 0 | 0 | 7.004 |
| NT2NE20015300 | 0 | 0 | 0 | 22.636 |
| NT2NE20016230 | 0 | 0 | 0 | 100 |
| NT2NE20016260 | 0 | 0 | 0 | 100 |
| NT2NE20016340 | 0 | 0 | 0 | 100 |
| NT2NE20016480 | 0 | 0 | 0 | 100 |
| NT2NE20016660 | 0 | 0 | 0 | 100 |
| NT2NE20016970 | 0 | 0 | 0 | 61.289 |
| NT2NE20034080 | 0 | 0 | 0 | 100 |
| NT2NE20044900 | 0 | 0 | 0 | 100 |
| NT2NE20047160 | 0 | 0 | 0 | 43 |
| NT2NE20054410 | 0 | 0 | 0 | 34.749 |
| NT2NE20055170 | 0 | 0 | 0 | 100 |
| NT2NE20057200 | 0 | 0 | 0 | 71.845 |
| OCBBF20009040 | 0 | 0 | 0 | 38.34 |
| OCBBF20015860 | 0 | 0 | 0 | 24.825 |
| PLACE60020840 | 0 | 0 | 0 | 8.288 |
| PROST10005260 | 0 | 0 | 0 | 11.86 |
| SKMUS20008630 | 0 | 0 | 0 | 2.785 |
| SMINT20003960 | 0 | 0 | 0 | 1.689 |
| STOMA20001210 | 0 | 0 | 0 | 2.199 |
| SYNOV20011440 | 0 | 0 | 0 | 4.179 |
| TESTI10000230 | 0 | 0 | 0 | 4.142 |
| TESTI20009700 | 0 | 0 | 0 | 15.218 |
| TESTI20040310 | 0 | 0 | 0 | 5.364 |
| THYMU10003290 | 0 | 0 | 0 | 34.388 |
| TRACH20013950 | 0 | 0 | 0 | 12.004 |
| BGGI120010970 | 0 | 0 | 2.974 | 0 |
| BNGH410001980 | 0 | 0 | 20.55 | 0 |
| BRACE10001660 | 0 | 0 | 11.3 | 0 |
| BRACE20014770 | 0 | 0 | 8.968 | 0 |
| BRACE20034490 | 0 | 0 | 6.108 | 0 |
| BRACE20071740 | 0 | 0 | 27.924 | 0 |
| BRAWH20009440 | 0 | 0 | 11.189 | 0 |
| BRAWH20036930 | 0 | 0 | 19.379 | 0 |
| CTONG20020730 | 0 | 0 | 25.686 | 0 |
| CTONG20028030 | 0 | 0 | 26.479 | 0 |
| FCBBF10006750 | 0 | 0 | 26.462 | 0 |
| FCBBF20012110 | 0 | 0 | 19.363 | 0 |
| FCBBF20015380 | 0 | 0 | 3.168 | 0 |
| FEBRA20007570 | 0 | 0 | 1.649 | 0 |
| FEBRA20043250 | 0 | 0 | 8.353 | 0 |
| FEBRA20068730 | 0 | 0 | 6.35 | 0 |
| HCASM10001150 | 0 | 0 | 1.43 | 0 |
| HCASM20002140 | 0 | 0 | 2.71 | 0 |
| HHDPC20000950 | 0 | 0 | 4.733 | 0 |
| HHDPC20004620 | 0 | 0 | 25.354 | 0 |
| HSYRA10001370 | 0 | 0 | 10.795 | 0 |
| HSYRA10001780 | 0 | 0 | 7.211 | 0 |
| HSYRA20001350 | 0 | 0 | 7.505 | 0 |
| HSYRA20006050 | 0 | 0 | 17.911 | 0 |
| IMR3210001580 | 0 | 0 | 5.369 | 0 |
| IMR3220002230 | 0 | 0 | 4.566 | 0 |
| IMR3220003020 | 0 | 0 | 4.387 | 0 |
| KIDNE20004030 | 0 | 0 | 3.815 | 0 |
| KIDNE20060300 | 0 | 0 | 1.994 | 0 |
| KIDNE20073280 | 0 | 0 | 6.225 | 0 |
| MESAN20005010 | 0 | 0 | 24.967 | 0 |
| NT2RI10000160 | 0 | 0 | 100 | 0 |
| NT2RI10000270 | 0 | 0 | 38.568 | 0 |
| NT2RI10000480 | 0 | 0 | 55.06 | 0 |
| NT2RI10001640 | 0 | 0 | 100 | 0 |
| NT2RI20002700 | 0 | 0 | 100 | 0 |
| NT2RI20002820 | 0 | 0 | 100 | 0 |
| NT2RI20003410 | 0 | 0 | 100 | 0 |
| NT2RI20004120 | 0 | 0 | 15.349 | 0 |

TABLE 4-continued

| Clone ID | NT2RM | NT2RP | NT2RI | NT2NE |
|---|---|---|---|---|
| NT2RI20005970 | 0 | 0 | 100 | 0 |
| NT2RI20006690 | 0 | 0 | 6.222 | 0 |
| NT2RI20006850 | 0 | 0 | 29.216 | 0 |
| NT2RI20007380 | 0 | 0 | 100 | 0 |
| NT2RI20008650 | 0 | 0 | 100 | 0 |
| NT2RI20010100 | 0 | 0 | 55.06 | 0 |
| NT2RI20010830 | 0 | 0 | 100 | 0 |
| NT2RI20010910 | 0 | 0 | 9.758 | 0 |
| NT2RI20012350 | 0 | 0 | 100 | 0 |
| NT2RI20012440 | 0 | 0 | 100 | 0 |
| NT2RI20014090 | 0 | 0 | 23.941 | 0 |
| NT2RI20015190 | 0 | 0 | 100 | 0 |
| NT2RI20015400 | 0 | 0 | 0.383 | 0 |
| NT2RI20016570 | 0 | 0 | 1.461 | 0 |
| NT2RI20017260 | 0 | 0 | 73.33 | 0 |
| NT2RI20018460 | 0 | 0 | 14.383 | 0 |
| NT2RI20018660 | 0 | 0 | 50.642 | 0 |
| NT2RI20020220 | 0 | 0 | 39.883 | 0 |
| NT2RI20020410 | 0 | 0 | 100 | 0 |
| NT2RI20021520 | 0 | 0 | 14.03 | 0 |
| NT2RI20022430 | 0 | 0 | 22.43 | 0 |
| NT2RI20022700 | 0 | 0 | 100 | 0 |
| NT2RI20025300 | 0 | 0 | 25.585 | 0 |
| NT2RI20025850 | 0 | 0 | 25.193 | 0 |
| NT2RI20026540 | 0 | 0 | 5.201 | 0 |
| NT2RI20028020 | 0 | 0 | 39.201 | 0 |
| NT2RI20028520 | 0 | 0 | 62.741 | 0 |
| NT2RI20029580 | 0 | 0 | 8.861 | 0 |
| NT2RI20029700 | 0 | 0 | 100 | 0 |
| NT2RI20030110 | 0 | 0 | 2.725 | 0 |
| NT2RI20030190 | 0 | 0 | 28.31 | 0 |
| NT2RI20030670 | 0 | 0 | 100 | 0 |
| NT2RI20031540 | 0 | 0 | 100 | 0 |
| NT2RI20032050 | 0 | 0 | 100 | 0 |
| NT2RI20032220 | 0 | 0 | 100 | 0 |
| NT2RI20033010 | 0 | 0 | 17.133 | 0 |
| NT2RI20033380 | 0 | 0 | 6.678 | 0 |
| NT2RI20033440 | 0 | 0 | 31.421 | 0 |
| NT2RI20033830 | 0 | 0 | 21.125 | 0 |
| NT2RI20036780 | 0 | 0 | 100 | 0 |
| NT2RI20041900 | 0 | 0 | 100 | 0 |
| NT2RI20042840 | 0 | 0 | 21.943 | 0 |
| NT2RI20043040 | 0 | 0 | 28.031 | 0 |
| NT2RI20043980 | 0 | 0 | 16.393 | 0 |
| NT2RI20044420 | 0 | 0 | 100 | 0 |
| NT2RI20047830 | 0 | 0 | 100 | 0 |
| NT2RI20048400 | 0 | 0 | 100 | 0 |
| NT2RI20049160 | 0 | 0 | 100 | 0 |
| NT2RI20049840 | 0 | 0 | 51.095 | 0 |
| NT2RI20049850 | 0 | 0 | 17.16 | 0 |
| NT2RI20050610 | 0 | 0 | 34.993 | 0 |
| NT2RI20050870 | 0 | 0 | 100 | 0 |
| NT2RI20056280 | 0 | 0 | 100 | 0 |
| NT2RI20056470 | 0 | 0 | 0.508 | 0 |
| NT2RI20058110 | 0 | 0 | 12.655 | 0 |
| NT2RI20060710 | 0 | 0 | 18.232 | 0 |
| NT2RI20060720 | 0 | 0 | 36.029 | 0 |
| NT2RI20061270 | 0 | 0 | 100 | 0 |
| NT2RI20061830 | 0 | 0 | 32.269 | 0 |
| NT2RI20062100 | 0 | 0 | 4.387 | 0 |
| NT2RI20063450 | 0 | 0 | 100 | 0 |
| NT2RI20064870 | 0 | 0 | 100 | 0 |
| NT2RI20065060 | 0 | 0 | 56.418 | 0 |
| NT2RI20065530 | 0 | 0 | 2.339 | 0 |
| NT2RI20066670 | 0 | 0 | 100 | 0 |
| NT2RI20066790 | 0 | 0 | 100 | 0 |
| NT2RI20067350 | 0 | 0 | 28.093 | 0 |
| NT2RI20067880 | 0 | 0 | 100 | 0 |
| NT2RI20068250 | 0 | 0 | 39.94 | 0 |
| NT2RI20068550 | 0 | 0 | 34.304 | 0 |
| NT2RI20070480 | 0 | 0 | 100 | 0 |
| NT2RI20070840 | 0 | 0 | 5.538 | 0 |
| NT2RI20070960 | 0 | 0 | 39.827 | 0 |
| NT2RI20071160 | 0 | 0 | 100 | 0 |
| NT2RI20071480 | 0 | 0 | 8.058 | 0 |
| NT2RI20072140 | 0 | 0 | 100 | 0 |
| NT2RI20072540 | 0 | 0 | 21.715 | 0 |
| NT2RI20073030 | 0 | 0 | 100 | 0 |
| NT2RI20073840 | 0 | 0 | 57.89 | 0 |
| NT2RI20073860 | 0 | 0 | 100 | 0 |
| NT2RI20074690 | 0 | 0 | 100 | 0 |
| NT2RI20075070 | 0 | 0 | 100 | 0 |
| NT2RI20077290 | 0 | 0 | 100 | 0 |
| NT2RI20077510 | 0 | 0 | 100 | 0 |
| NT2RI20077540 | 0 | 0 | 39.213 | 0 |
| NT2RI20078270 | 0 | 0 | 39.208 | 0 |
| NT2RI20078790 | 0 | 0 | 9.741 | 0 |
| NT2RI20078910 | 0 | 0 | 100 | 0 |
| NT2RI20080500 | 0 | 0 | 100 | 0 |
| NT2RI20081880 | 0 | 0 | 100 | 0 |
| NT2RI20082210 | 0 | 0 | 2.823 | 0 |
| NT2RI20083360 | 0 | 0 | 5.348 | 0 |
| NT2RI20085260 | 0 | 0 | 3.491 | 0 |
| NT2RI20085980 | 0 | 0 | 2.71 | 0 |
| NT2RI20086560 | 0 | 0 | 13.947 | 0 |
| NT2RI20087140 | 0 | 0 | 50.642 | 0 |
| NT2RI20087490 | 0 | 0 | 1.932 | 0 |
| NT2RI20088010 | 0 | 0 | 100 | 0 |
| NT2RI20088120 | 0 | 0 | 15.273 | 0 |
| NT2RI20090830 | 0 | 0 | 24.964 | 0 |
| NT2RI20091440 | 0 | 0 | 100 | 0 |
| NT2RI20092150 | 0 | 0 | 100 | 0 |
| NT2RI20092890 | 0 | 0 | 100 | 0 |
| NTONG10001820 | 0 | 0 | 8.461 | 0 |
| OCBBF20002770 | 0 | 0 | 39.883 | 0 |
| OCBBF20011240 | 0 | 0 | 7.83 | 0 |
| PEBLM10001440 | 0 | 0 | 18.541 | 0 |
| PLACE50001130 | 0 | 0 | 16.492 | 0 |
| PLACE60014430 | 0 | 0 | 3.227 | 0 |
| PROST20029600 | 0 | 0 | 40.276 | 0 |
| PUAEN10000570 | 0 | 0 | 8.916 | 0 |
| SALGL10001570 | 0 | 0 | 1.34 | 0 |
| SKMUS10000220 | 0 | 0 | 3.288 | 0 |
| SKMUS20004670 | 0 | 0 | 25.34 | 0 |
| STOMA20002890 | 0 | 0 | 1.705 | 0 |
| SYNOV10001280 | 0 | 0 | 4.538 | 0 |
| TESTI20012690 | 0 | 0 | 3.275 | 0 |
| TESTI20023690 | 0 | 0 | 44.022 | 0 |
| TESTI20028660 | 0 | 0 | 10.313 | 0 |
| TESTI20068720 | 0 | 0 | 21.478 | 0 |
| THYMU10000020 | 0 | 0 | 27.219 | 0 |
| THYMU10000830 | 0 | 0 | 8.95 | 0 |
| TRACH20002370 | 0 | 0 | 13.11 | 0 |
| 3NB6910001290 | 0 | 9.099 | 0 | 0 |
| BRACE10000700 | 0 | 22.972 | 0 | 0 |
| BRACE20003320 | 0 | 14.937 | 0 | 0 |
| BRACE20015080 | 0 | 26.275 | 0 | 0 |
| BRACE20079020 | 0 | 59.759 | 0 | 0 |
| BRACE20083800 | 0 | 4.248 | 0 | 0 |
| BRACE20092740 | 0 | 42.609 | 0 | 0 |
| FEBRA20008810 | 0 | 9.264 | 0 | 0 |
| FEBRA20017150 | 0 | 30.227 | 0 | 0 |
| FEBRA20067930 | 0 | 58.409 | 0 | 0 |
| HHDPC20000550 | 0 | 14.432 | 0 | 0 |
| HSYRA20008280 | 0 | 7.137 | 0 | 0 |
| HSYRA20014760 | 0 | 5.313 | 0 | 0 |
| KIDNE10001450 | 0 | 19.263 | 0 | 0 |
| KIDNE20000850 | 0 | 4.841 | 0 | 0 |
| KIDNE20002660 | 0 | 7.078 | 0 | 0 |
| KIDNE20003300 | 0 | 20.763 | 0 | 0 |
| KIDNE20033050 | 0 | 1.709 | 0 | 0 |
| KIDNE20045340 | 0 | 17.723 | 0 | 0 |
| NT2RP60000080 | 0 | 100 | 0 | 0 |
| NT2RP60000170 | 0 | 100 | 0 | 0 |
| NT2RP60000320 | 0 | 100 | 0 | 0 |
| NT2RP60000390 | 0 | 100 | 0 | 0 |
| NT2RP60000590 | 0 | 100 | 0 | 0 |
| NT2RP60000860 | 0 | 100 | 0 | 0 |
| NT2RP60001000 | 0 | 100 | 0 | 0 |
| NT2RP60001230 | 0 | 5.146 | 0 | 0 |
| NT2RP60001270 | 0 | 100 | 0 | 0 |
| NT2RP70000410 | 0 | 100 | 0 | 0 |
| NT2RP70000690 | 0 | 66.955 | 0 | 0 |
| NT2RP70002590 | 0 | 31.56 | 0 | 0 |

TABLE 4-continued

| Clone ID | NT2RM | NT2RP | NT2RI | NT2NE |
|---|---|---|---|---|
| NT2RP70002710 | 0 | 14.558 | 0 | 0 |
| NT2RP70003640 | 0 | 100 | 0 | 0 |
| NT2RP70003910 | 0 | 100 | 0 | 0 |
| NT2RP70004250 | 0 | 100 | 0 | 0 |
| NT2RP70005790 | 0 | 100 | 0 | 0 |
| NT2RP70006240 | 0 | 100 | 0 | 0 |
| NT2RP70008120 | 0 | 100 | 0 | 0 |
| NT2RP70009060 | 0 | 8.617 | 0 | 0 |
| NT2RP70012310 | 0 | 24.404 | 0 | 0 |
| NT2RP70013060 | 0 | 49.874 | 0 | 0 |
| NT2RP70013350 | 0 | 30.221 | 0 | 0 |
| NT2RP70015910 | 0 | 22.4 | 0 | 0 |
| NT2RP70018560 | 0 | 100 | 0 | 0 |
| NT2RP70021510 | 0 | 49.439 | 0 | 0 |
| NT2RP70022430 | 0 | 33.36 | 0 | 0 |
| NT2RP70023760 | 0 | 17.87 | 0 | 0 |
| NT2RP70024490 | 0 | 22.701 | 0 | 0 |
| NT2RP70024500 | 0 | 19.57 | 0 | 0 |
| NT2RP70025540 | 0 | 100 | 0 | 0 |
| NT2RP70026190 | 0 | 9.482 | 0 | 0 |
| NT2RP70028290 | 0 | 49.972 | 0 | 0 |
| NT2RP70028410 | 0 | 100 | 0 | 0 |
| NT2RP70030500 | 0 | 100 | 0 | 0 |
| NT2RP70030910 | 0 | 20.809 | 0 | 0 |
| NT2RP70033040 | 0 | 100 | 0 | 0 |
| NT2RP70036290 | 0 | 9.965 | 0 | 0 |
| NT2RP70036470 | 0 | 24.999 | 0 | 0 |
| NT2RP70039600 | 0 | 15.306 | 0 | 0 |
| NT2RP70040800 | 0 | 100 | 0 | 0 |
| NT2RP70042040 | 0 | 9.773 | 0 | 0 |
| NT2RP70042330 | 0 | 60.574 | 0 | 0 |
| NT2RP70042600 | 0 | 71.279 | 0 | 0 |
| NT2RP70043730 | 0 | 7.505 | 0 | 0 |
| NT2RP70043960 | 0 | 100 | 0 | 0 |
| NT2RP70045410 | 0 | 24.679 | 0 | 0 |
| NT2RP70046560 | 0 | 100 | 0 | 0 |
| NT2RP70046870 | 0 | 100 | 0 | 0 |
| NT2RP70047510 | 0 | 100 | 0 | 0 |
| NT2RP70047660 | 0 | 100 | 0 | 0 |
| NT2RP70047900 | 0 | 18.549 | 0 | 0 |
| NT2RP70049250 | 0 | 27.784 | 0 | 0 |
| NT2RP70049750 | 0 | 100 | 0 | 0 |
| NT2RP70052050 | 0 | 64.358 | 0 | 0 |
| NT2RP70052190 | 0 | 100 | 0 | 0 |
| NT2RP70054680 | 0 | 100 | 0 | 0 |
| NT2RP70054930 | 0 | 49.38 | 0 | 0 |
| NT2RP70055130 | 0 | 3.248 | 0 | 0 |
| NT2RP70055200 | 0 | 19.133 | 0 | 0 |
| NT2RP70061620 | 0 | 100 | 0 | 0 |
| NT2RP70061880 | 0 | 20.642 | 0 | 0 |
| NT2RP70062960 | 0 | 100 | 0 | 0 |
| NT2RP70063040 | 0 | 100 | 0 | 0 |
| NT2RP70063740 | 0 | 100 | 0 | 0 |
| NT2RP70064080 | 0 | 100 | 0 | 0 |
| NT2RP70066210 | 0 | 100 | 0 | 0 |
| NT2RP70067010 | 0 | 100 | 0 | 0 |
| NT2RP70069800 | 0 | 40.229 | 0 | 0 |
| NT2RP70071140 | 0 | 33.145 | 0 | 0 |
| NT2RP70071540 | 0 | 49.972 | 0 | 0 |
| NT2RP70072210 | 0 | 100 | 0 | 0 |
| NT2RP70072520 | 0 | 100 | 0 | 0 |
| NT2RP70073590 | 0 | 100 | 0 | 0 |
| NT2RP70073810 | 0 | 100 | 0 | 0 |
| NT2RP70074060 | 0 | 100 | 0 | 0 |
| NT2RP70075040 | 0 | 100 | 0 | 0 |
| NT2RP70076100 | 0 | 36.014 | 0 | 0 |
| NT2RP70076170 | 0 | 100 | 0 | 0 |
| NT2RP70076430 | 0 | 100 | 0 | 0 |
| NT2RP70079250 | 0 | 100 | 0 | 0 |
| NT2RP70079300 | 0 | 71.279 | 0 | 0 |
| NT2RP70081330 | 0 | 100 | 0 | 0 |
| NT2RP70081370 | 0 | 26.129 | 0 | 0 |
| NT2RP70081420 | 0 | 100 | 0 | 0 |
| NT2RP70081440 | 0 | 100 | 0 | 0 |
| NT2RP70081670 | 0 | 100 | 0 | 0 |
| NT2RP70083150 | 0 | 100 | 0 | 0 |
| NT2RP70084060 | 0 | 100 | 0 | 0 |
| NT2RP70084410 | 0 | 65.611 | 0 | 0 |
| NT2RP70084870 | 0 | 48.444 | 0 | 0 |
| NT2RP70085500 | 0 | 100 | 0 | 0 |
| NT2RP70085570 | 0 | 9.069 | 0 | 0 |
| NT2RP70086230 | 0 | 100 | 0 | 0 |
| NT2RP70087200 | 0 | 100 | 0 | 0 |
| NT2RP70088550 | 0 | 15.625 | 0 | 0 |
| NT2RP70090120 | 0 | 49.497 | 0 | 0 |
| NT2RP70090190 | 0 | 100 | 0 | 0 |
| NT2RP70091490 | 0 | 49.38 | 0 | 0 |
| NT2RP70091680 | 0 | 100 | 0 | 0 |
| NT2RP70092150 | 0 | 100 | 0 | 0 |
| NT2RP70092360 | 0 | 100 | 0 | 0 |
| NT2RP70093630 | 0 | 100 | 0 | 0 |
| NT2RP70093700 | 0 | 100 | 0 | 0 |
| NT2RP70093940 | 0 | 24.073 | 0 | 0 |
| NT2RP70093970 | 0 | 100 | 0 | 0 |
| NT2RP70094290 | 0 | 100 | 0 | 0 |
| NT2RP70094660 | 0 | 100 | 0 | 0 |
| NT2RP70094810 | 0 | 58.409 | 0 | 0 |
| NT2RP70094980 | 0 | 44.133 | 0 | 0 |
| NT2RP70095020 | 0 | 100 | 0 | 0 |
| NT2RP70095070 | 0 | 100 | 0 | 0 |
| NTONG10000980 | 0 | 10.097 | 0 | 0 |
| NTONG10002140 | 0 | 12.777 | 0 | 0 |
| NTONG20002650 | 0 | 10.048 | 0 | 0 |
| NTONG20016120 | 0 | 21.562 | 0 | 0 |
| PEBLM20003950 | 0 | 8.711 | 0 | 0 |
| PROST10005640 | 0 | 10.708 | 0 | 0 |
| PROST20003250 | 0 | 24.163 | 0 | 0 |
| SKNMC20000650 | 0 | 3.384 | 0 | 0 |
| SKNSH10000860 | 0 | 23.605 | 0 | 0 |
| SKNSH20003470 | 0 | 15.832 | 0 | 0 |
| TESTI10000510 | 0 | 11.33 | 0 | 0 |
| TESTI10000960 | 0 | 51.106 | 0 | 0 |
| TESTI20015110 | 0 | 65.524 | 0 | 0 |
| TESTI20074640 | 0 | 12.147 | 0 | 0 |
| TRACH20004610 | 0 | 13.344 | 0 | 0 |

TABLE 5

| Clone ID | BEAST | TBAES |
|---|---|---|
| 3NB6910001730 | 0 | 33.793 |
| FCBBF10007600 | 0 | 75.606 |
| KIDNE20033050 | 0 | 40.478 |
| KIDNE20060300 | 0 | 69.585 |
| NT2RI20065530 | 0 | 81.65 |
| NT2RP60000720 | 0 | 69.448 |
| NT2RP70075370 | 0 | 57.062 |
| TRACH20004200 | 0 | 94.946 |
| LIVER10000670 | 68.212 | 0 |
| LIVER10005420 | 78.818 | 0 |
| LIVER20000370 | 73.799 | 0 |

TABLE 6

| Clone ID | CERVX | TCERX |
|---|---|---|
| BRACE10001590 | 0 | 57.778 |
| HHDPC20000950 | 0 | 40.177 |
| HSYRA20016210 | 0 | 10.84 |
| NT2RI20074980 | 0 | 46.086 |
| 3NB6920014330 | 69.325 | 0 |
| NT2RI20087490 | 33.161 | 0 |
| NT2RP60001090 | 80.827 | 0 |
| PROST10002200 | 42.592 | 0 |
| SKNMC20003220 | 58.42 | 0 |
| STOMA20001210 | 49.81 | 0 |

TABLE 7

| Clone ID | COLON | TCOLN |
|---|---|---|
| BRACE20028610 | 0 | 95.142 |
| BRACE20011170 | 78.541 | 0 |
| BRACE20035940 | 95.04 | 0 |
| IMR3220013320 | 60.529 | 0 |
| NT2NE20053710 | 26.798 | 0 |

TABLE 8

| Clone ID | NESOP | TESOP |
|---|---|---|
| KIDNE20005740 | 0 | 54.924 |
| MAMGL10000320 | 0 | 13.581 |
| NESOP10000870 | 49.196 | 0 |
| NT2RI20056470 | 69.766 | 0 |
| NTONG20008000 | 78.683 | 0 |

TABLE 9

| Clone ID | KIDNE | TKIDN |
|---|---|---|
| 3NB6920002810 | 0 | 1.507 |
| ADRGL10000020 | 0 | 12.08 |
| BNGH420004740 | 0 | 3.392 |
| BRACE10000200 | 0 | 33.823 |
| BRACE10000420 | 0 | 4.476 |
| BRACE10000730 | 0 | 35.7 |
| BRACE10001590 | 0 | 3.051 |
| BRACE20005650 | 0 | 55.211 |
| BRACE20016730 | 0 | 41.8 |
| BRACE20028120 | 0 | 21.571 |
| BRACE20077980 | 0 | 4.39 |
| BRACE20083800 | 0 | 15.501 |
| BRACE20083850 | 0 | 25.281 |
| BRAWH10001740 | 0 | 23 |
| BRAWH20036930 | 0 | 11.581 |
| BRAWH20064500 | 0 | 14.412 |
| BRAWH20064930 | 0 | 40.792 |
| CTONG20028030 | 0 | 15.825 |
| FCBBF20015380 | 0 | 17.038 |
| FEBRA20005360 | 0 | 7.956 |
| FEBRA20007570 | 0 | 2.956 |
| FEBRA20008740 | 0 | 4.47 |
| FEBRA20012270 | 0 | 24.184 |
| FEBRA20025250 | 0 | 20.688 |
| HSYRA20002480 | 0 | 3.392 |
| HSYRA20006400 | 0 | 4.833 |
| HSYRA20008280 | 0 | 2.894 |
| HSYRA20015740 | 0 | 9.842 |
| HSYRA20016210 | 0 | 2.862 |
| IMR3220009350 | 0 | 4.967 |
| LIVER10001110 | 0 | 25.88 |
| NT2NE20003920 | 0 | 3.741 |
| NT2NE20007630 | 0 | 18.497 |
| NT2NE20007870 | 0 | 6.961 |
| NT2RI20025410 | 0 | 21.344 |
| NT2RI20026540 | 0 | 4.662 |
| NT2RI20029580 | 0 | 15.887 |
| NT2RI20033380 | 0 | 23.947 |
| NT2RI20033830 | 0 | 12.625 |
| NT2RI20051500 | 0 | 4.126 |
| NT2RI20058110 | 0 | 7.563 |
| NT2RI20090650 | 0 | 3.609 |
| NT2RP60000720 | 0 | 3.567 |
| NT2RP70013350 | 0 | 9.191 |
| NT2RP70023790 | 0 | 2.777 |
| NT2RP70024490 | 0 | 27.614 |
| NT2RP70028750 | 0 | 3.807 |
| NT2RP70029060 | 0 | 11.18 |

TABLE 9-continued

| Clone ID | KIDNE | TKIDN |
|---|---|---|
| NT2RP70036800 | 0 | 7.976 |
| NT2RP70075370 | 0 | 2.931 |
| NT2RP70076100 | 0 | 14.603 |
| NTONG10000980 | 0 | 8.189 |
| NTONG10002460 | 0 | 4.695 |
| NTONG20015500 | 0 | 30.566 |
| OCBBF20002310 | 0 | 20.844 |
| OCBBF20013070 | 0 | 18.625 |
| PEBLM20001470 | 0 | 8.936 |
| PEBLM20003950 | 0 | 5.298 |
| PLACE60021510 | 0 | 12.663 |
| PLACE60040050 | 0 | 6.961 |
| PLACE60043970 | 0 | 7.802 |
| PROST20051430 | 0 | 37.542 |
| STOMA20001210 | 0 | 2.602 |
| STOMA20002570 | 0 | 14.983 |
| STOMA20002890 | 0 | 1.528 |
| SYNOV20011440 | 0 | 4.944 |
| TESTI10000230 | 0 | 4.9 |
| TESTI20009700 | 0 | 18.005 |
| TESTI20021490 | 0 | 8.135 |
| TESTI20032800 | 0 | 21.55 |
| TESTI20053960 | 0 | 9.979 |
| TESTI20080200 | 0 | 1.673 |
| TESTI20082400 | 0 | 2.876 |
| BGGI120010970 | 4.336 | 0 |
| BRACE20004210 | 3.583 | 0 |
| BRACE20005250 | 6.242 | 23.03 |
| BRACE20011170 | 3.303 | 0 |
| BRACE20020910 | 19.111 | 0 |
| BRACE20080970 | 20.33 | 0 |
| BRAWH20000340 | 10.476 | 0 |
| BRAWH20006970 | 3.96 | 0 |
| BRAWH20011660 | 5.897 | 0 |
| FCBBF20001950 | 65.363 | 0 |
| FEBRA20043250 | 12.177 | 0 |
| HLUNG10000640 | 23.921 | 0 |
| IMR3220007420 | 2.375 | 0 |
| IMR3220014350 | 4.092 | 0 |
| KIDNE10000080 | 22.13 | 0 |
| KIDNE10000280 | 100 | 0 |
| KIDNE10000500 | 15.868 | 0 |
| KIDNE10001040 | 100 | 0 |
| KIDNE10001430 | 100 | 0 |
| KIDNE10001450 | 19.052 | 0 |
| KIDNE10001520 | 100 | 0 |
| KIDNE20000410 | 100 | 0 |
| KIDNE20000510 | 100 | 0 |
| KIDNE20000700 | 100 | 0 |
| KIDNE20000850 | 4.788 | 0 |
| KIDNE20001670 | 100 | 0 |
| KIDNE20001920 | 100 | 0 |
| KIDNE20002440 | 37.565 | 0 |
| KIDNE20002450 | 100 | 0 |
| KIDNE20002660 | 7 | 0 |
| KIDNE20003150 | 100 | 0 |
| KIDNE20003300 | 20.536 | 0 |
| KIDNE20003490 | 64.026 | 5.625 |
| KIDNE20003750 | 100 | 0 |
| KIDNE20004030 | 5.561 | 0 |
| KIDNE20004220 | 35.77 | 0 |
| KIDNE20004970 | 12.49 | 0 |
| KIDNE20005130 | 100 | 0 |
| KIDNE20005170 | 81.524 | 0 |
| KIDNE20005190 | 100 | 0 |
| KIDNE20005740 | 2.3 | 0 |
| KIDNE20031850 | 16.193 | 0 |
| KIDNE20033050 | 3.381 | 0 |
| KIDNE20033350 | 100 | 0 |
| KIDNE20033570 | 53.825 | 0 |
| KIDNE20033730 | 100 | 0 |
| KIDNE20033770 | 100 | 0 |
| KIDNE20037520 | 100 | 0 |
| KIDNE20039410 | 100 | 0 |
| KIDNE20039940 | 43.968 | 0 |
| KIDNE20040340 | 100 | 0 |
| KIDNE20040540 | 49.114 | 0 |

TABLE 9-continued

| Clone ID | KIDNE | TKIDN |
|---|---|---|
| KIDNE20040840 | 100 | 0 |
| KIDNE20042620 | 100 | 0 |
| KIDNE20042940 | 100 | 0 |
| KIDNE20042950 | 100 | 0 |
| KIDNE20043440 | 100 | 0 |
| KIDNE20044110 | 7.51 | 0 |
| KIDNE20045200 | 100 | 0 |
| KIDNE20045340 | 17.53 | 0 |
| KIDNE20045790 | 100 | 0 |
| KIDNE20046810 | 100 | 0 |
| KIDNE20048280 | 100 | 0 |
| KIDNE20048640 | 34.264 | 0 |
| KIDNE20048790 | 100 | 0 |
| KIDNE20049810 | 100 | 0 |
| KIDNE20050420 | 35.626 | 0 |
| KIDNE20052960 | 100 | 0 |
| KIDNE20053360 | 58.142 | 0 |
| KIDNE20054000 | 49.697 | 0 |
| KIDNE20054770 | 100 | 0 |
| KIDNE20056290 | 100 | 0 |
| KIDNE20056760 | 16.262 | 0 |
| KIDNE20059080 | 100 | 0 |
| KIDNE20059370 | 88.03 | 0 |
| KIDNE20060140 | 13.852 | 0 |
| KIDNE20060300 | 2.906 | 0 |
| KIDNE20060530 | 100 | 0 |
| KIDNE20060620 | 100 | 0 |
| KIDNE20061490 | 100 | 0 |
| KIDNE20062990 | 31.685 | 0 |
| KIDNE20063530 | 26.747 | 0 |
| KIDNE20063760 | 100 | 0 |
| KIDNE20066520 | 70.185 | 0 |
| KIDNE20067600 | 100 | 0 |
| KIDNE20067750 | 8.487 | 0 |
| KIDNE20068800 | 24.137 | 0 |
| KIDNE20070050 | 66.711 | 0 |
| KIDNE20070770 | 100 | 0 |
| KIDNE20071860 | 39.822 | 0 |
| KIDNE20073280 | 4.537 | 0 |
| KIDNE20073520 | 8.83 | 3.62 |
| KIDNE20073560 | 100 | 0 |
| KIDNE20074220 | 100 | 0 |
| KIDNE20075690 | 100 | 0 |
| KIDNE20078100 | 100 | 0 |
| KIDNE20078110 | 100 | 0 |
| LIVER10000790 | 15.673 | 0 |
| MAMGL10000320 | 1.138 | 0 |
| NB9N410000470 | 3.598 | 0 |
| NT2NE20053710 | 1.127 | 0 |
| NT2RI20006710 | 2.454 | 0 |
| NT2RI20013420 | 2.015 | 0 |
| NT2RI20016570 | 23.435 | 0 |
| NT2RI20018460 | 20.967 | 0 |
| NT2RI20025540 | 5.573 | 0 |
| NT2RI20040590 | 13.676 | 0 |
| NT2RI20065530 | 3.41 | 0 |
| NT2RI20087490 | 1.408 | 0 |
| NT2RI20087910 | 2.824 | 0 |
| NT2RP60000350 | 5.311 | 0 |
| NT2RP60001230 | 5.09 | 0 |
| NT2RP70043730 | 14.846 | 0 |
| NT2RP70069860 | 10.745 | 26.431 |
| NT2RP70074220 | 3.96 | 0 |
| OCBBF20014940 | 49.164 | 0 |
| PLACE60020840 | 2.658 | 0 |
| PLACE60043120 | 3.992 | 9.82 |
| PROST10003430 | 25.547 | 0 |
| SKNSH20001510 | 20.208 | 0 |
| SMINT10000160 | 38.817 | 15.914 |
| SPLEN20000470 | 66.711 | 0 |
| SPLEN20001340 | 88.909 | 0 |
| SPLEN20003570 | 31.635 | 0 |
| STOMA10000470 | 17.849 | 0 |
| TESTI10000700 | 25.214 | 0 |
| TESTI20027070 | 14.795 | 0 |
| TESTI20040310 | 2.58 | 0 |
| TRACH10000300 | 11.119 | 0 |

TABLE 9-continued

| Clone ID | KIDNE | TKIDN |
|---|---|---|
| TRACH20000790 | 4.534 | 11.153 |
| TRACH20002500 | 35.282 | 0 |
| TRACH20007800 | 5.605 | 0 |

TABLE 10

| Clone ID | LIVER | TLIVE |
|---|---|---|
| FCBBF50002610 | 0 | 88.758 |
| FEBRA20076220 | 0 | 53.946 |
| KIDNE20033050 | 0 | 40.878 |
| NT2NE20003840 | 0 | 70.165 |
| KIDNE20062480 | 7.391 | 0 |
| KIDNE20068800 | 60.015 | 0 |
| LIVER10000580 | 100 | 0 |
| LIVER10000670 | 31.788 | 0 |
| LIVER10000790 | 77.941 | 0 |
| LIVER10000990 | 100 | 0 |
| LIVER10001040 | 100 | 0 |
| LIVER10001110 | 52.319 | 0 |
| LIVER10001750 | 100 | 0 |
| LIVER10002300 | 66.114 | 0 |
| LIVER10002780 | 100 | 0 |
| LIVER10003030 | 100 | 0 |
| LIVER10004330 | 100 | 0 |
| LIVER10005420 | 13.604 | 0 |
| LIVER20000330 | 100 | 0 |
| LIVER20004160 | 33.27 | 0 |
| LIVER20004460 | 100 | 0 |
| LIVER20005150 | 100 | 0 |
| NT2NE20002140 | 27.596 | 0 |
| NT2RI20030510 | 18.459 | 0 |
| NT2RI20043040 | 50.8 | 0 |
| NT2RI20090650 | 7.296 | 0 |
| PROST10005640 | 26.335 | 0 |
| PROST20032320 | 15.404 | 0 |
| SALGL10001570 | 2.428 | 0 |
| SMINT10000160 | 32.172 | 0 |
| SPLEN20002420 | 83.286 | 0 |
| TESTI20002530 | 26.418 | 0 |
| TESTI20080200 | 3.383 | 0 |
| THYMU10003590 | 7.302 | 0 |
| TRACH20004720 | 6.356 | 0 |

TABLE 11

| Clone ID | HLUNG | TLUNG |
|---|---|---|
| NT2R120030110 | 0 | 94.571 |
| BNGH410001980 | 16.113 | 0 |
| BRACE10000420 | 7.831 | 0 |
| BRACE10001150 | 1.339 | 0 |
| BRACE20014770 | 28.126 | 0 |
| BRACE20018550 | 25.65 | 0 |
| BRAWH20006970 | 8.521 | 0 |
| BRAWH20014610 | 7.03 | 77.801 |
| FEBRA20008810 | 19.713 | 0 |
| FEBRA20015840 | 53.019 | 0 |
| FEBRA20044120 | 15.75 | 0 |
| HHDPC20001490 | 25.611 | 0 |
| HLUNG10000240 | 100 | 0 |
| HLUNG10000300 | 100 | 0 |
| HLUNG10000370 | 100 | 0 |
| HLUNG10000640 | 51.466 | 0 |
| HLUNG10000760 | 12.838 | 0 |
| HLUNG10000990 | 100 | 0 |
| HLUNG10001050 | 100 | 0 |
| HLUNG10001100 | 100 | 0 |

TABLE 11-continued

| Clone ID | HLUNG | TLUNG |
|---|---|---|
| HLUNG20000680 | 72.532 | 0 |
| HLUNG20001160 | 100 | 0 |
| HLUNG20001250 | 100 | 0 |
| HLUNG20001420 | 79.349 | 0 |
| HLUNG20001760 | 100 | 0 |
| HLUNG20002550 | 100 | 0 |
| HLUNG20003140 | 14.018 | 0 |
| HLUNG20004120 | 42.131 | 0 |
| HLUNG20004800 | 100 | 0 |
| HLUNG20005010 | 5.302 | 0 |
| HSYRA20014200 | 12.578 | 0 |
| K1DNE20002660 | 15.061 | 0 |
| K1DNE20033050 | 3.637 | 0 |
| NT2NE20014350 | 28.99 | 0 |
| NT2R120016570 | 9.167 | 0 |
| NT2R120026540 | 8.156 | 0 |
| NT2R120051500 | 21.652 | 0 |
| NT2R120064120 | 9.093 | 0 |
| NT2R120083960 | 17.851 | 0 |
| NT2R120085260 | 5.474 | 0 |
| NT2R120087490 | 3.03 | 0 |
| NT2RP70009060 | 18.337 | 0 |
| NT2RP70011660 | 5.822 | 0 |
| NT2RP70029060 | 6.519 | 0 |
| NT2RP70055020 | 10.451 | 0 |
| NT2RP70074220 | 8.521 | 0 |
| NT2RP70076100 | 25.546 | 0 |
| NT0NG10002460 | 16.426 | 0 |
| NT0NG20008000 | 7.189 | 0 |
| PLACE60043120 | 8.589 | 0 |
| SKMUS20016340 | 15.317 | 0 |
| SKNMC20005930 | 13.727 | 0 |
| SMINT20000180 | 38.989 | 0 |
| SM1NT20002390 | 51.283 | 0 |
| SM1NT20002770 | 12.776 | 0 |
| SM1NT20003960 | 10.489 | 0 |
| ST0MA10000470 | 38.402 | 0 |
| ST0MA20001880 | 52.43 | 0 |
| SYN0V20013740 | 23.798 | 0 |
| TEST120036250 | 32.684 | 0 |
| TESTI20080200 | 2.927 | 0 |
| TRA0H20004610 | 28.395 | 0 |

TABLE 12

| Clone ID | NOVAR | TOVAR |
|---|---|---|
| BRACE20011880 | 0 | 93.107 |
| TESTI20030710 | 0 | 79.631 |
| BRACE20076210 | 97.13 | 0 |
| NT2R120053680 | 78.467 | 0 |
| SKMUS20008630 | 61.727 | 0 |
| TESTI20005910 | 94.963 | 0 |
| TESTI20040310 | 59.442 | 0 |

TABLE 13

| Clone ID | STOMA | TSTOM |
|---|---|---|
| HSYRA20011030 | 0 | 60.206 |
| NT2R120013420 | 0 | 48.779 |
| NT2RP70079750 | 0 | 74.336 |
| BRACE20003320 | 28.838 | 0 |
| HEART20005060 | 8.996 | 0 |
| HHDPC20000950 | 3.367 | 0 |
| HLUNG20004120 | 38.225 | 0 |
| HLUNG20005010 | 4.81 | 0 |
| HSYRA20006400 | 23.013 | 0 |
| KIDNE100Q0SQ0 | 30.974 | 0 |
| K1DNE20062480 | 2.901 | 0 |

TABLE 13-continued

| Clone ID | STOMA | TSTOM |
|---|---|---|
| NT2NE20053710 | 2.2 | 0 |
| NT2NE20054410 | 65.251 | 0 |
| NT2R120015400 | 0.544 | 0 |
| NT2R120016570 | 4.159 | 0 |
| NT2R120064120 | 8.25 | 0 |
| NT2R120070840 | 15.758 | 0 |
| NT2R120071330 | 13.128 | 0 |
| NT2R120074980 | 3.862 | 0 |
| NT2R120077230 | 20.833 | 0 |
| NT2R120089420 | 17.218 | 0 |
| NT2RP70000760 | 4.442 | 0 |
| NT2RP70028750 | 3.021 | 0 |
| PLACE60014430 | 9.182 | 0 |
| PLACE60024190 | 54.046 | 0 |
| SKNMC20000970 | 4.463 | 0 |
| STOMA10000470 | 34.842 | 0 |
| STOMA10000520 | 100 | 0 |
| STOMA10001170 | 100 | 0 |
| STOMA10001330 | 100 | 0 |
| STOMA10001860 | 100 | 0 |
| STOMA20000320 | 100 | 0 |
| ST0MA20000880 | 100 | 0 |
| STOMA20001210 | 4.129 | 0 |
| ST0MA20001880 | 47.57 | 0 |
| ST0MA20002570 | 23.78 | 0 |
| ST0MA20002890 | 4.851 | 0 |
| ST0MA20003960 | 100 | 0 |
| ST0MA20004780 | 100 | 0 |
| ST0MA20004820 | 28.859 | 0 |
| THYMU10003590 | 5.733 | 0 |

TABLE 14

| Clone ID | UTERU | TUTER |
|---|---|---|
| NT2RI20085260 | 0 | 60.829 |
| 3NB6920002810 | 1.339 | 0 |
| BRACE10000420 | 15.908 | 0 |
| BRACE20089990 | 28.795 | 0 |
| BRACE20092120 | 61.611 | 0 |
| BRAWH10001680 | 49.225 | 0 |
| BRAWH20011410 | 14.576 | 0 |
| BRAWH20011660 | 3.222 | 0 |
| FCBBF20005910 | 17.567 | 0 |
| FCBBF50002610 | 4.011 | 0 |
| FEBRA20005360 | 7.069 | 0 |
| FEBRA20006800 | 81.993 | 0 |
| FEBRA20008800 | 29.932 | 0 |
| FEBRA20044120 | 7.999 | 0 |
| FEBRA20057520 | 14.823 | 0 |
| HEART20005060 | 5.036 | 0 |
| HHDPC20000950 | 1.885 | 0 |
| HLUNG10000760 | 3.26 | 0 |
| HLUNG20003140 | 7.12 | 0 |
| HSYRA20014200 | 6.388 | 0 |
| HSYRA20014760 | 5.742 | 0 |
| HSYRA20015800 | 36.126 | 0 |
| IMR3210002420 | 7.465 | 0 |
| IMR3220002230 | 3.637 | 0 |
| IMR3220009350 | 4.412 | 0 |
| IMR3220014350 | 4.472 | 0 |
| IMR3220016000 | 0.788 | 0 |
| KIDNE20000850 | 5.232 | 0 |
| KIDNE20060140 | 15.135 | 0 |
| KIDNE20060300 | 3.176 | 0 |
| MAMGL10000350 | 1.122 | 0 |
| NT2NE20035690 | 11.316 | 0 |
| NT2NE20053710 | 1.232 | 0 |
| NT2RI10000270 | 61.432 | 0 |
| NT2RI20000640 | 3.308 | 0 |
| NT2RI20002940 | 19.984 | 0 |
| NT2RI20010910 | 15.542 | 0 |
| NT2RI20013420 | 2.201 | 0 |

TABLE 14-continued

| Clone ID | UTERU | TUTER |
|---|---|---|
| NT2RI20016570 | 2.328 | 0 |
| NT2RI20033380 | 10.637 | 0 |
| NT2RI20036950 | 5.07 | 0 |
| NT2RI20037510 | 2.677 | 0 |
| NT2RI20053350 | 2.517 | 0 |
| NT2RI20057230 | 2.613 | 0 |
| NT2RI20058110 | 6.719 | 0 |
| NT2RI20071480 | 25.67 | 0 |
| NT2RI20074980 | 4.324 | 0 |
| NT2RI20084810 | 20.5 | 0 |
| NT2RI20087490 | 1.539 | 0 |
| NT2RI20087910 | 12.345 | 0 |
| NT2RP60000350 | 1.451 | 0 |
| NT2RP70032030 | 4.778 | 0 |
| NT2RP70043730 | 8.111 | 0 |
| NTONG10000980 | 7.275 | 0 |
| NTONG10002460 | 4.171 | 0 |
| PLACE60014430 | 10.28 | 0 |
| PLACE60026680 | 15.19 | 0 |
| PLACE60043960 | 10.64 | 0 |
| PLACE60044910 | 52.136 | 0 |
| PLACE60047380 | 52.136 | 0 |
| PROST10002200 | 1.976 | 0 |
| PROST10005260 | 12.466 | 0 |
| PROST20025910 | 51.788 | 0 |
| PROST20033380 | 16.15 | 0 |
| PUAEN10000570 | 14.201 | 0 |
| SALGL10001570 | 1.067 | 0 |
| SKMUS10000140 | 23.507 | 0 |
| SKMUS20003430 | 35.091 | 0 |
| SKMUS20009540 | 9.414 | 0 |
| SKNMC10002510 | 6.618 | 0 |
| SKNMC20000970 | 2.498 | 0 |
| SKNSH10000860 | 25.511 | 0 |
| SMINT20002770 | 3.244 | 0 |
| STOMA20002890 | 2.716 | 0 |
| SYNOV20011440 | 4.393 | 0 |
| TESTI10000230 | 8.707 | 0 |
| TESTI20018290 | 12.741 | 0 |
| TESTI20021490 | 14.455 | 0 |
| TESTI20080200 | 2.973 | 0 |
| TESTI20082400 | 2.555 | 0 |
| TRACH10000300 | 12.149 | 0 |
| TRACH20002370 | 20.883 | 0 |
| TRACH20007800 | 12.248 | 0 |
| TRACH20012890 | 4.662 | 0 |
| UTERU10000770 | 100 | 0 |
| UTERU10000960 | 50.58 | 0 |
| UTERU10001600 | 100 | 0 |
| UTERU10001920 | 100 | 0 |
| UTERU20000470 | 100 | 0 |
| UTERU20003380 | 35.158 | 0 |
| UTERU20003930 | 100 | 0 |
| UTERU20004850 | 100 | 0 |
| UTERU20005410 | 33.583 | 0 |
| UTERU20005690 | 50.58 | 0 |

TABLE 15

| Clone ID | NTONG | CTONG |
|---|---|---|
| 3NB6910001160 | 0 | 6.048 |
| 3NB6910001290 | 0 | 3.009 |
| 3NB6910001730 | 0 | 0.944 |
| BNGH420004740 | 0 | 3.688 |
| BRACE20008850 | 0 | 15.357 |
| BRACE20020910 | 0 | 12.778 |
| BRACE20074010 | 0 | 5.637 |
| BRAWH20014840 | 0 | 5.251 |
| BRAWH20089560 | 0 | 21.778 |
| CTONG20003030 | 0 | 100 |
| CTONG20005890 | 0 | 39.66 |
| CTONG20007710 | 0 | 100 |
| CTONG20008270 | 0 | 18.957 |
| CTONG20011390 | 0 | 100 |
| CTONG20013200 | 0 | 19.93 |
| CTONG20013660 | 0 | 100 |
| CTONG20015330 | 0 | 100 |
| CTONG20018200 | 0 | 100 |
| CTONG20019110 | 0 | 48.152 |
| CTONG20019550 | 0 | 100 |
| CTONG20020730 | 0 | 25.035 |
| CTONG20021430 | 0 | 100 |
| CTONG20024180 | 0 | 100 |
| CTONG20024530 | 0 | 23.734 |
| CTONG20025580 | 0 | 57.263 |
| CTONG20027210 | 0 | 100 |
| CTONG20028030 | 0 | 8.603 |
| CTONG20028160 | 0 | 100 |
| CTONG20028200 | 0 | 55.786 |
| CTONG20029650 | 0 | 100 |
| CTONG20037820 | 0 | 100 |
| CTONG20047160 | 0 | 100 |
| CTONG20055530 | 0 | 38.023 |
| CTONG20064490 | 0 | 24.327 |
| FEBRA20003770 | 0 | 22.646 |
| FEBRA20004520 | 0 | 19.228 |
| FEBRA20007400 | 0 | 4.377 |
| FEBRA20007570 | 0 | 1.607 |
| FEBRA20012940 | 0 | 7.503 |
| FEBRA20021940 | 0 | 1.128 |
| FEBRA20044120 | 0 | 4.895 |
| HCASM10001150 | 0 | 1.394 |
| HHDPC20004560 | 0 | 18.986 |
| HLUNG20003140 | 0 | 4.356 |
| HSYRA20002480 | 0 | 3.688 |
| IMR3220009350 | 0 | 2.7 |
| IMR3220012180 | 0 | 3.684 |
| KIDNE20000850 | 0 | 1.601 |
| KIDNE20002660 | 0 | 9.361 |
| KIDNE20004220 | 0 | 23.916 |
| KIDNE20005740 | 0 | 1.538 |
| KIDNE20056760 | 0 | 21.746 |
| KIDNE20060140 | 0 | 9.261 |
| KIDNE20062480 | 0 | 2.981 |
| MESAN20000920 | 0 | 19.727 |
| MESAN20003370 | 0 | 17.82 |
| NHNPC20002060 | 0 | 4.429 |
| NT2NE10001850 | 0 | 39.142 |
| NT2NE20000560 | 0 | 8.845 |
| NT2NE20002140 | 0 | 7.421 |
| NT2NE20003270 | 0 | 27.905 |
| NT2NE20003840 | 0 | 1.94 |
| NT2NE20014350 | 0 | 4.505 |
| NT2NE20053710 | 0 | 3.014 |
| NT2RI20006690 | 0 | 12.129 |
| NT2RI20006710 | 0 | 1.64 |
| NT2RI20016570 | 0 | 1.424 |
| NT2RI20018660 | 0 | 49.358 |
| NT2RI20025300 | 0 | 49.872 |
| NT2RI20025410 | 0 | 11.603 |
| NT2RI20030190 | 0 | 27.593 |
| NT2RI20030510 | 0 | 9.928 |
| NT2RI20036950 | 0 | 6.205 |
| NT2RI20046060 | 0 | 12.778 |
| NT2RI20053350 | 0 | 4.621 |
| NT2RI20067350 | 0 | 27.381 |
| NT2RI20075720 | 0 | 8.573 |
| NT2RI20078790 | 0 | 3.165 |
| NT2RI20083960 | 0 | 5.548 |
| NT2RI20087140 | 0 | 49.358 |
| NT2RI20094060 | 0 | 8.828 |
| NT2RP60000350 | 0 | 5.327 |
| NT2RP60001230 | 0 | 6.806 |
| NT2RP70000760 | 0 | 12.173 |
| NT2RP70004770 | 0 | 36.51 |
| NT2RP70009060 | 0 | 5.699 |
| NT2RP70011660 | 0 | 5.428 |
| NT2RP70023760 | 0 | 11.817 |
| NT2RP70023790 | 0 | 3.02 |

TABLE 15-continued

| Clone ID | NTONG | CTONG |
|---|---|---|
| NT2RP70024500 | 0 | 12.942 |
| NT2RP70026190 | 0 | 12.541 |
| NT2RP70029820 | 0 | 10.391 |
| NT2RP70036470 | 0 | 33.064 |
| NT2RP70043730 | 0 | 4.963 |
| NT2RP70061880 | 0 | 27.302 |
| NT2RP70071770 | 0 | 18.778 |
| NT2RP70076100 | 0 | 7.939 |
| NT2RP70079750 | 0 | 4.105 |
| NT2RP70084870 | 0 | 32.036 |
| NT2RP70093730 | 0 | 19.806 |
| OCBBF20013070 | 0 | 5.063 |
| PEBLM20003950 | 0 | 5.761 |
| PLACE60037450 | 0 | 33.178 |
| PLACE60043120 | 0 | 2.669 |
| PROST10003430 | 0 | 34.162 |
| PROST10005260 | 0 | 7.628 |
| PROST20032320 | 0 | 8.285 |
| PROST20033020 | 0 | 6.218 |
| PROST20056040 | 0 | 29.772 |
| SKNMC10002510 | 0 | 8.098 |
| SKNMC20000650 | 0 | 4.476 |
| SKNMC20010570 | 0 | 4.712 |
| SKNSH20003470 | 0 | 10.47 |
| SMINT20000180 | 0 | 24.233 |
| SYNOV20013740 | 0 | 7.396 |
| TESTI10000230 | 0 | 7.991 |
| TESTI10001680 | 0 | 8.412 |
| TESTI20007840 | 0 | 17.514 |
| TESTI20021490 | 0 | 4.422 |
| TESTI20022230 | 0 | 62.139 |
| TESTI20023690 | 0 | 42.906 |
| TESTI20030050 | 0 | 1.535 |
| TESTI20042950 | 0 | 76.649 |
| TESTI20068720 | 0 | 10.467 |
| TESTI20080200 | 0 | 0.91 |
| TRACH20012890 | 0 | 1.426 |
| BRACE20006980 | 55.471 | 0 |
| BRACE20092740 | 22.273 | 0 |
| BRAWH20006970 | 8.372 | 0 |
| FCBBF10007600 | 6.676 | 0 |
| FEBRA20062700 | 19.42 | 6.142 |
| IMR3220016000 | 3.049 | 0.482 |
| KIDNE20073280 | 9.592 | 3.034 |
| MAMGL10000350 | 2.171 | 0 |

TABLE 15-continued

| Clone ID | NTONG | CTONG |
|---|---|---|
| NT2NE20035690 | 21.893 | 0 |
| NT2RI20056470 | 23.487 | 5.448 |
| NT2RI20058110 | 12.999 | 0 |
| NT2RI20084810 | 13.22 | 0 |
| NT2RI20085260 | 5.378 | 0 |
| NT2RP70015910 | 46.836 | 14.813 |
| NT2RP70036290 | 20.836 | 59.311 |
| NT2RP70036320 | 18.528 | 46.879 |
| NT2RP70074220 | 8.372 | 0 |
| NT2RP70075370 | 5.038 | 0 |
| NTONG10000330 | 100 | 0 |
| NTONG10000520 | 44.434 | 0 |
| NTONG10001230 | 100 | 0 |
| NTONG10001300 | 100 | 0 |
| NTONG10001820 | 39.112 | 0 |
| NTONG10002140 | 80.147 | 0 |
| NTONG10002460 | 8.07 | 0 |
| NTONG10002570 | 100 | 0 |
| NTONG10002640 | 67.153 | 0 |
| NTONG20002650 | 21.01 | 6.645 |
| NTONG20003340 | 27.701 | 0 |
| NTONG20003630 | 100 | 0 |
| NTONG20004920 | 100 | 0 |
| NTONG20005830 | 100 | 0 |
| NTONG20008000 | 14.128 | 0 |
| NTONG20008780 | 100 | 0 |
| NTONG20009660 | 100 | 0 |
| NTONG20009850 | 100 | 0 |
| NTONG20011370 | 100 | 0 |
| NTONG20012220 | 100 | 0 |
| NTONG20014280 | 76.302 | 0 |
| NTONG20015500 | 52.537 | 0 |
| NTONG20016120 | 45.084 | 0 |
| OCBBF20011240 | 24.128 | 0 |
| OCBBF20015860 | 50.483 | 0 |
| PROST10002200 | 22.942 | 1.209 |
| SKMUS20016340 | 15.05 | 4.76 |
| SKNMC20000970 | 4.833 | 1.529 |
| ST0MA20004820 | 31.253 | 9.885 |
| SYNOV10001280 | 13.986 | 0 |
| SYNOV20011440 | 8.499 | 0 |
| THYMU10000830 | 27.581 | 0 |
| TRACH20000790 | 19.169 | 0 |
| TRACH20009260 | 30.323 | 9.59 |

TABLE 16

| Clone ID | FCBBF | FEBRA | OCBBF | BRACE | BRALZ | BRAMY | BRAWH | BR-CAN | BRCOC | BRHIP | BRSSN | BRSTN | BRTHA |
|---|---|---|---|---|---|---|---|---|---|---|---|---|---|
| BRACE20028960 | 0 | 0 | 0 | 37.659 | 0 | 0 | 62.341 | 0 | 0 | 0 | 0 | 0 | 0 |
| BRACE20074010 | 0 | 0 | 0 | 17.222 | 8.739 | 16.608 | 28.509 | 5.549 | 8.568 | 5.733 | 0 | 0 | 0 |
| BRACE20077080 | 0 | 0 | 0 | 8.944 | 0 | 0 | 14.807 | 17.29 | 26.699 | 0 | 0 | 0 | 0 |
| BRACE20077980 | 0 | 0 | 0 | 7.291 | 7.4 | 2.344 | 8.046 | 9.396 | 3.627 | 4.854 | 19.055 | 18.412 | 0 |
| BRACE20083800 | 0 | 0 | 0 | 2.86 | 8.709 | 8.275 | 4.735 | 11.059 | 12.807 | 5.713 | 4.485 | 17.335 | 0 |
| BRACE20088570 | 0 | 0 | 0 | 24.099 | 0 | 0 | 39.894 | 0 | 0 | 0 | 0 | 0 | 0 |
| BRAWH10000010 | 0 | 0 | 0 | 0 | 15.441 | 0 | 33.582 | 9.804 | 15.139 | 10.129 | 15.905 | 0 | 0 |
| BRAWH10000020 | 0 | 0 | 0 | 0 | 0 | 0 | 100 | 0 | 0 | 0 | 0 | 0 | 0 |
| BRAWH10000070 | 0 | 0 | 0 | 0 | 0 | 0 | 34.097 | 0 | 0 | 0 | 0 | 0 | 0 |
| BRAWH10000370 | 0 | 0 | 0 | 0 | 0 | 0 | 34.637 | 0 | 0 | 0 | 0 | 0 | 0 |
| BRAWH10000940 | 0 | 0 | 0 | 0 | 0 | 0 | 100 | 0 | 0 | 0 | 0 | 0 | 0 |
| BRAWH10001300 | 0 | 0 | 0 | 0 | 0 | 0 | 100 | 0 | 0 | 0 | 0 | 0 | 0 |
| BRAWH10001640 | 0 | 0 | 0 | 0 | 0 | 0 | 100 | 0 | 0 | 0 | 0 | 0 | 0 |
| BRAWH10001680 | 0 | 0 | 0 | 0 | 0 | 0 | 50.775 | 0 | 0 | 0 | 0 | 0 | 0 |
| BRAWH10001740 | 0 | 0 | 0 | 0 | 0 | 0 | 21.077 | 36.92 | 19.003 | 0 | 0 | 0 | 0 |
| BRAWH10001800 | 0 | 0 | 0 | 0 | 0 | 0 | 100 | 0 | 0 | 0 | 0 | 0 | 0 |
| BRAWH20000340 | 0 | 0 | 0 | 0 | 0 | 0 | 11.808 | 0 | 10.646 | 0 | 0 | 0 | 0 |
| BRAWH20000340 | 0 | 0 | 0 | 0 | 0 | 0 | 11.808 | 0 | 10.646 | 0 | 0 | 0 | 0 |
| BRAWH20000480 | 0 | 0 | 0 | 0 | 0 | 0 | 100 | 0 | 0 | 0 | 0 | 0 | 0 |
| BRAWH20000930 | 0 | 0 | 0 | 0 | 0 | 0 | 100 | 0 | 0 | 0 | 0 | 0 | 0 |
| BRAWH20001770 | 0 | 0 | 0 | 0 | 0 | 0 | 11.171 | 6.522 | 0 | 6.739 | 0 | 0 | 0 |

TABLE 16-continued

| Clone ID | FCBBF | FEBRA | OCBBF | BRACE | BRALZ | BRAMY | BRAWH | BR-CAN | BRCOC | BRHIP | BRSSN | BRSTN | BRTHA |
|---|---|---|---|---|---|---|---|---|---|---|---|---|---|
| BRAWH20002480 | 0 | 0 | 0 | 0 | 0 | 0 | 100 | 0 | 0 | 0 | 0 | 0 | 0 |
| BRAWH20003230 | 0 | 0 | 0 | 0 | 0 | 0 | 100 | 0 | 0 | 0 | 0 | 0 | 0 |
| BRAWH20004430 | 0 | 0 | 0 | 0 | 0 | 0 | 100 | 0 | 0 | 0 | 0 | 0 | 0 |
| BRAWH20004760 | 0 | 0 | 0 | 0 | 0 | 0 | 62.374 | 0 | 0 | 37.626 | 0 | 0 | 0 |
| BRAWH20005030 | 0 | 0 | 0 | 0 | 0 | 0 | 32.294 | 0 | 0 | 38.962 | 0 | 0 | 0 |
| BRAWH20005540 | 0 | 0 | 0 | 0 | 0 | 0 | 100 | 0 | 0 | 0 | 0 | 0 | 0 |
| BRAWH20006330 | 0 | 0 | 0 | 0 | 0 | 3.43 | 5.888 | 0 | 0 | 0 | 0 | 0 | 0 |
| BRAWH20006510 | 0 | 0 | 0 | 0 | 0 | 0 | 100 | 0 | 0 | 0 | 0 | 0 | 0 |
| BRAWH20006970 | 0 | 0 | 0 | 0 | 8.209 | 0 | 8.927 | 2.606 | 12.073 | 2.693 | 8.456 | 8.171 | 0 |
| BRAWH20008660 | 0 | 0 | 0 | 0 | 0 | 0 | 100 | 0 | 0 | 0 | 0 | 0 | 0 |
| BRAWH20008920 | 0 | 0 | 0 | 0 | 0 | 0 | 100 | 0 | 0 | 0 | 0 | 0 | 0 |
| BRAWH20009010 | 0 | 0 | 0 | 0 | 0 | 0 | 100 | 0 | 0 | 0 | 0 | 0 | 0 |
| BRAWH20009440 | 0 | 0 | 0 | 0 | 0 | 0 | 18.383 | 0 | 0 | 0 | 0 | 0 | 0 |
| BRAWH20009840 | 0 | 0 | 0 | 0 | 0 | 0 | 100 | 0 | 0 | 0 | 0 | 0 | 0 |

TABLE 17

| | | | | | | | | | | | | | |
|---|---|---|---|---|---|---|---|---|---|---|---|---|---|
| BRAWH20011030 | 0 | 0 | 0 | 0 | 0 | 0 | 69.012 | 0 | 0 | 0 | 0 | 0 | 0 |
| BRAWH20011290 | 0 | 0 | 0 | 0 | 0 | 0 | 100 | 0 | 0 | 0 | 0 | 0 | 0 |
| BRAWH20011660 | 0 | 0 | 0 | 0 | 0 | 1.936 | 3.323 | 0 | 0 | 0 | 0 | 3.042 | 0 |
| BRAWH20012030 | 0 | 0 | 0 | 0 | 0 | 0 | 100 | 0 | 0 | 0 | 0 | 0 | 0 |
| BRAWH20014180 | 0 | 0 | 0 | 14.525 | 11.056 | 7.004 | 24.046 | 7.02 | 10.84 | 14.505 | 0 | 11.004 | 0 |
| BRAWH20014380 | 0 | 0 | 0 | 0 | 0 | 0 | 100 | 0 | 0 | 0 | 0 | 0 | 0 |
| BRAWH20014610 | 0 | 0 | 0 | 0 | 0 | 2.145 | 3.683 | 0 | 0 | 0 | 0 | 0 | 9.34 |
| BRAWH20015030 | 0 | 0 | 0 | 0 | 0 | 0 | 100 | 0 | 0 | 0 | 0 | 0 | 0 |
| BRAWH20036890 | 0 | 0 | 0 | 0 | 0 | 0 | 100 | 0 | 0 | 0 | 0 | 0 | 0 |
| BRAWH20038320 | 0 | 0 | 0 | 0 | 0 | 0 | 100 | 0 | 0 | 0 | 0 | 0 | 0 |
| BRAWH20047310 | 0 | 0 | 0 | 0 | 0 | 0 | 100 | 0 | 0 | 0 | 0 | 0 | 0 |
| BRAWH20059980 | 0 | 0 | 0 | 0 | 0 | 0 | 63.136 | 36.864 | 0 | 0 | 0 | 0 | 0 |
| BRAWH20060440 | 0 | 0 | 0 | 0 | 0 | 0 | 100 | 0 | 0 | 0 | 0 | 0 | 0 |
| BRAWH20064930 | 0 | 0 | 0 | 0 | 0 | 0 | 37.381 | 21.826 | 0 | 0 | 0 | 0 | 0 |
| BRAWH20066220 | 0 | 0 | 0 | 0 | 0 | 0 | 100 | 0 | 0 | 0 | 0 | 0 | 0 |
| BRAWH20069600 | 0 | 0 | 0 | 0 | 0 | 0 | 100 | 0 | 0 | 0 | 0 | 0 | 0 |
| BRAWH20069890 | 0 | 0 | 0 | 27.609 | 0 | 0 | 45.705 | 26.686 | 0 | 0 | 0 | 0 | 0 |
| BRAWH20074060 | 0 | 0 | 0 | 0 | 0 | 0 | 100 | 0 | 0 | 0 | 0 | 0 | 0 |
| BRAWH20076050 | 0 | 0 | 0 | 0 | 0 | 0 | 100 | 0 | 0 | 0 | 0 | 0 | 0 |
| BRAWH20089560 | 0 | 0 | 0 | 0 | 0 | 0 | 36.711 | 0 | 0 | 0 | 0 | 0 | 0 |
| BRAWH20092270 | 0 | 0 | 0 | 0 | 0 | 0 | 100 | 0 | 0 | 0 | 0 | 0 | 0 |
| BRAWH20092610 | 0 | 0 | 0 | 0 | 0 | 0 | 100 | 0 | 0 | 0 | 0 | 0 | 0 |
| BRAWH20093600 | 0 | 0 | 0 | 0 | 0 | 0 | 32.978 | 0 | 29.733 | 0 | 0 | 0 | 0 |
| BRAWH20094850 | 0 | 0 | 0 | 0 | 0 | 0 | 100 | 0 | 0 | 0 | 0 | 0 | 0 |
| IMR3220013170 | 0 | 0 | 0 | 5.763 | 6.58 | 0 | 2.385 | 1.393 | 0 | 0 | 0 | 15.282 | 0 |
| KIDNE20000850 | 0 | 0 | 0 | 1.63 | 0 | 0 | 2.698 | 0 | 0 | 0 | 2.556 | 0 | 0 |
| KIDNE20004220 | 0 | 0 | 0 | 0 | 0 | 0 | 40.315 | 0 | 0 | 0 | 0 | 0 | 0 |
| KIDNE20031850 | 0 | 0 | 0 | 0 | 0 | 0 | 9.125 | 0 | 0 | 0 | 0 | 0 | 46.286 |
| KIDNE20050420 | 0 | 0 | 0 | 0 | 0 | 0 | 40.153 | 0 | 0 | 24.222 | 0 | 0 | 0 |
| MAMGL10000350 | 0 | 0 | 0 | 0 | 0 | 0 | 1.157 | 0 | 0 | 0 | 0 | 0 | 0 |
| NT2NE20001740 | 0 | 0 | 0 | 2.567 | 0 | 0 | 4.249 | 2.481 | 3.831 | 0 | 8.049 | 0 | 0 |
| NT2RI20042840 | 0 | 0 | 0 | 0 | 0 | 42.005 | 36.052 | 0 | 0 | 0 | 0 | 0 | 0 |
| NT2RI20086560 | 0 | 0 | 0 | 0 | 0 | 0 | 22.915 | 0 | 0 | 0 | 0 | 0 | 0 |
| NT2RP70002590 | 0 | 0 | 0 | 0 | 0 | 0 | 35.182 | 20.542 | 0 | 0 | 0 | 0 | 0 |
| NT2RP70065270 | 0 | 0 | 0 | 0 | 0 | 0 | 1.855 | 0 | 0 | 1.119 | 0 | 0 | 0 |
| NT2RP70074220 | 0 | 0 | 0 | 0 | 8.209 | 0 | 8.927 | 2.606 | 12.073 | 2.693 | 8.456 | 8.171 | 0 |

TABLE 18

| | | | | | | | | | | | | | |
|---|---|---|---|---|---|---|---|---|---|---|---|---|---|
| NTONG10001820 | 0 | 0 | 0 | 0 | 0 | 0 | 6.951 | 0 | 6.267 | 4.193 | 0 | 6.362 | 0 |
| PEBLM20001470 | 0 | 0 | 0 | 0 | 0 | 19.082 | 8.189 | 0 | 0 | 9.88 | 0 | 0 | 0 |
| PLACE60032040 | 0 | 0 | 0 | 0 | 0 | 0 | 35.969 | 0 | 0 | 0 | 0 | 0 | 0 |
| SKMUS10000140 | 0 | 0 | 0 | 0 | 0 | 0 | 24.247 | 0 | 0 | 0 | 0 | 0 | 0 |
| SMINT20005450 | 0 | 0 | 0 | 0 | 0 | 0 | 22.035 | 0 | 0 | 0 | 0 | 0 | 0 |
| TESTI20004350 | 0 | 0 | 0 | 0 | 0 | 0 | 44.17 | 0 | 0 | 0 | 0 | 0 | 0 |
| TESTI20008830 | 0 | 0 | 0 | 0 | 0 | 0 | 20.762 | 0 | 18.719 | 0 | 0 | 38.006 | 0 |
| TRACH20007800 | 0 | 0 | 0 | 0 | 0 | 3.68 | 6.317 | 0 | 5.695 | 0 | 0 | 0 | 0 |
| TRACH20016070 | 0 | 0 | 0 | 0 | 0 | 11.565 | 19.852 | 0 | 0 | 0 | 0 | 0 | 0 |

TABLE 18-continued

| | | | | | | | | | | | | | |
|---|---|---|---|---|---|---|---|---|---|---|---|---|---|
| UMVEN20001330 | 0 | 0 | 0 | 0 | 0 | 0 | 3.329 | 0 | 0 | 0 | 0 | 0 | 0 |
| 3NB6910001730 | 0 | 0 | 0 | 0 | 2.926 | 0 | 0 | 0 | 0 | 0.96 | 0 | 1.456 | 0 |
| 3NB6920002810 | 0 | 0 | 0 | 0 | 0 | 0.805 | 0 | 1.613 | 1.245 | 0.833 | 0 | 0 | 0 |
| ADRGL20000740 | 0 | 0 | 0 | 0 | 0 | 19.598 | 0 | 0 | 0 | 0 | 0 | 30.792 | 0 |
| BNGH410001370 | 0 | 0 | 0 | 0 | 0 | 15.04 | 0 | 0 | 0 | 0 | 0 | 0 | 0 |
| BNGH410001980 | 0 | 0 | 0 | 0 | 0 | 0 | 0 | 0 | 0 | 0 | 0 | 15.451 | 0 |
| BRACE10000200 | 0 | 0 | 0 | 18.724 | 0 | 0 | 0 | 0 | 0 | 0 | 0 | 0 | 0 |
| BRACE10000730 | 0 | 0 | 0 | 19.762 | 15.042 | 0 | 0 | 0 | 0 | 29.495 | 0 | 0 | 0 |
| BRACE10000930 | 0 | 0 | 0 | 100 | 0 | 0 | 0 | 0 | 0 | 0 | 0 | 0 | 0 |
| BRACE20000770 | 0 | 0 | 0 | 100 | 0 | 0 | 0 | 0 | 0 | 0 | 0 | 0 | 0 |
| BRACE20001000 | 0 | 0 | 0 | 100 | 0 | 0 | 0 | 0 | 0 | 0 | 0 | 0 | 0 |
| BRACE20001410 | 0 | 0 | 0 | 100 | 0 | 0 | 0 | 0 | 0 | 0 | 0 | 0 | 0 |
| BRACE20002800 | 0 | 0 | 0 | 28.46 | 0 | 0 | 0 | 0 | 0 | 28.42 | 0 | 43.121 | 0 |
| BRACE20003320 | 0 | 0 | 0 | 10.059 | 0 | 0 | 0 | 0 | 0 | 0 | 0 | 0 | 0 |
| BRACE20005050 | 0 | 0 | 0 | 100 | 0 | 0 | 0 | 0 | 0 | 0 | 0 | 0 | 0 |
| BRACE20005250 | 0 | 0 | 0 | 12.749 | 6.469 | 0 | 0 | 8.215 | 6.342 | 8.487 | 6.664 | 0 | 0 |
| BRACE20005450 | 0 | 0 | 0 | 100 | 0 | 0 | 0 | 0 | 0 | 0 | 0 | 0 | 0 |
| BRACE20005650 | 0 | 0 | 0 | 15.282 | 0 | 14.737 | 0 | 14.771 | 0 | 0 | 0 | 0 | 0 |
| BRACE20005650 | 0 | 0 | 0 | 15.282 | 0 | 14.737 | 0 | 14.771 | 0 | 0 | 0 | 0 | 0 |
| BRACE20005770 | 0 | 0 | 0 | 62.564 | 0 | 0 | 0 | 0 | 0 | 0 | 0 | 0 | 0 |
| BRACE20006980 | 0 | 0 | 0 | 17.865 | 0 | 0 | 0 | 0 | 26.664 | 0 | 0 | 0 | 0 |
| BRACE20007180 | 0 | 0 | 0 | 100 | 0 | 0 | 0 | 0 | 0 | 0 | 0 | 0 | 0 |
| BRACE20008850 | 0 | 0 | 0 | 15.638 | 0 | 0 | 0 | 0 | 0 | 0 | 0 | 0 | 0 |
| BRACE20009880 | 0 | 0 | 0 | 100 | 0 | 0 | 0 | 0 | 0 | 0 | 0 | 0 | 0 |
| BRACE20010650 | 0 | 0 | 0 | 16.902 | 51.46 | 0 | 0 | 0 | 0 | 0 | 0 | 0 | 0 |
| BRACE20010700 | 0 | 0 | 0 | 38.94 | 0 | 0 | 0 | 0 | 0 | 0 | 61.06 | 0 | 0 |
| BRACE20011170 | 0 | 0 | 0 | 2.249 | 3.424 | 0 | 0 | 0 | 0 | 0 | 0 | 0 | 0 |

TABLE 19

| | | | | | | | | | | | | | |
|---|---|---|---|---|---|---|---|---|---|---|---|---|---|
| BRACE20011430 | 0 | 0 | 0 | 23.186 | 0 | 0 | 0 | 0 | 0 | 0 | 0 | 0 | 0 |
| BRACE20011430 | 0 | 0 | 0 | 23.186 | 0 | 0 | 0 | 0 | 0 | 0 | 0 | 0 | 0 |
| BRACE20011880 | 0 | 0 | 0 | 2.733 | 4.16 | 0 | 0 | 0 | 0 | 0 | 0 | 0 | 0 |
| BRACE20013400 | 0 | 0 | 0 | 100 | 0 | 0 | 0 | 0 | 0 | 0 | 0 | 0 | 0 |
| BRACE20013520 | 0 | 0 | 0 | 100 | 0 | 0 | 0 | 0 | 0 | 0 | 0 | 0 | 0 |
| BRACE20013740 | 0 | 0 | 0 | 50.907 | 0 | 49.093 | 0 | 0 | 0 | 0 | 0 | 0 | 0 |
| BRACE20013750 | 0 | 0 | 0 | 24 | 0 | 0 | 0 | 0 | 0 | 0 | 0 | 0 | 0 |
| BRACE20014230 | 0 | 0 | 0 | 100 | 0 | 0 | 0 | 0 | 0 | 0 | 0 | 0 | 0 |
| BRACE20014530 | 0 | 0 | 0 | 100 | 0 | 0 | 0 | 0 | 0 | 0 | 0 | 0 | 0 |
| BRACE20014550 | 0 | 0 | 0 | 100 | 0 | 0 | 0 | 0 | 0 | 0 | 0 | 0 | 0 |
| BRACE20014770 | 0 | 0 | 0 | 8.901 | 0 | 0 | 0 | 0 | 0 | 8.888 | 0 | 0 | 0 |
| BRACE20014920 | 0 | 0 | 0 | 100 | 0 | 0 | 0 | 0 | 0 | 0 | 0 | 0 | 0 |
| BRACE20015080 | 0 | 0 | 0 | 17.694 | 0 | 0 | 0 | 0 | 0 | 0 | 0 | 0 | 0 |
| BRACE20015430 | 0 | 0 | 0 | 100 | 0 | 0 | 0 | 0 | 0 | 0 | 0 | 0 | 0 |
| BRACE20016730 | 0 | 0 | 0 | 23.14 | 0 | 0 | 0 | 0 | 0 | 0 | 0 | 35.06 | 0 |
| BRACE20016920 | 0 | 0 | 0 | 100 | 0 | 0 | 0 | 0 | 0 | 0 | 0 | 0 | 0 |
| BRACE20017370 | 0 | 0 | 0 | 100 | 0 | 0 | 0 | 0 | 0 | 0 | 0 | 0 | 0 |
| BRACE20018550 | 0 | 0 | 0 | 8.117 | 0 | 0 | 0 | 0 | 0 | 0 | 0 | 0 | 0 |
| BRACE20018590 | 0 | 0 | 0 | 100 | 0 | 0 | 0 | 0 | 0 | 0 | 0 | 0 | 0 |
| BRACE20018650 | 0 | 0 | 0 | 100 | 0 | 0 | 0 | 0 | 0 | 0 | 0 | 0 | 0 |
| BRACE20018980 | 0 | 0 | 0 | 100 | 0 | 0 | 0 | 0 | 0 | 0 | 0 | 0 | 0 |
| BRACE20021510 | 0 | 0 | 0 | 100 | 0 | 0 | 0 | 0 | 0 | 0 | 0 | 0 | 0 |
| BRACE20021760 | 0 | 0 | 0 | 100 | 0 | 0 | 0 | 0 | 0 | 0 | 0 | 0 | 0 |
| BRACE20022020 | 0 | 0 | 0 | 100 | 0 | 0 | 0 | 0 | 0 | 0 | 0 | 0 | 0 |
| BRACE20022270 | 0 | 0 | 0 | 100 | 0 | 0 | 0 | 0 | 0 | 0 | 0 | 0 | 0 |
| BRACE20024090 | 0 | 0 | 0 | 100 | 0 | 0 | 0 | 0 | 0 | 0 | 0 | 0 | 0 |
| BRACE20024090 | 0 | 0 | 0 | 100 | 0 | 0 | 0 | 0 | 0 | 0 | 0 | 0 | 0 |
| BRACE20024310 | 0 | 0 | 0 | 100 | 0 | 0 | 0 | 0 | 0 | 0 | 0 | 0 | 0 |
| BRACE20024680 | 0 | 0 | 0 | 100 | 0 | 0 | 0 | 0 | 0 | 0 | 0 | 0 | 0 |
| BRACE20024950 | 0 | 0 | 0 | 39.759 | 0 | 0 | 0 | 0 | 0 | 0 | 60.241 | 0 | 0 |
| BRACE20025900 | 0 | 0 | 0 | 100 | 0 | 0 | 0 | 0 | 0 | 0 | 0 | 0 | 0 |
| BRACE20026350 | 0 | 0 | 0 | 100 | 0 | 0 | 0 | 0 | 0 | 0 | 0 | 0 | 0 |
| BRACE20026850 | 0 | 0 | 0 | 23.391 | 0 | 0 | 0 | 0 | 0 | 0 | 0 | 0 | 0 |
| BRACE20027360 | 0 | 0 | 0 | 100 | 0 | 0 | 0 | 0 | 0 | 0 | 0 | 0 | 0 |
| BRACE20027520 | 0 | 0 | 0 | 29.06 | 0 | 0 | 0 | 0 | 0 | 0 | 0 | 0 | 0 |
| BRACE20027550 | 0 | 0 | 0 | 34.821 | 0 | 0 | 0 | 0 | 0 | 0 | 0 | 0 | 0 |

TABLE 20

| | | | | | | | | | | | | | |
|---|---|---|---|---|---|---|---|---|---|---|---|---|---|
| BRACE20027720 | 0 | 0 | 0 | 100 | 0 | 0 | 0 | 0 | 0 | 0 | 0 | 0 | 0 |
| BRACE20027920 | 0 | 0 | 0 | 100 | 0 | 0 | 0 | 0 | 0 | 0 | 0 | 0 | 0 |
| BRACE20027960 | 0 | 0 | 0 | 100 | 0 | 0 | 0 | 0 | 0 | 0 | 0 | 0 | 0 |
| BRACE20028120 | 0 | 0 | 0 | 59.705 | 0 | 0 | 0 | 0 | 0 | 0 | 18.724 | 0 | 0 |
| BRACE20028600 | 0 | 0 | 0 | 100 | 0 | 0 | 0 | 0 | 0 | 0 | 0 | 0 | 0 |
| BRACE20030780 | 0 | 0 | 0 | 39.759 | 0 | 0 | 0 | 0 | 0 | 0 | 0 | 60.241 | 0 |
| BRACE20032850 | 0 | 0 | 0 | 100 | 0 | 0 | 0 | 0 | 0 | 0 | 0 | 0 | 0 |
| BRACE20033190 | 0 | 0 | 0 | 23.804 | 0 | 0 | 0 | 0 | 0 | 0 | 0 | 0 | 0 |
| BRACE20033980 | 0 | 0 | 0 | 39.646 | 60.354 | 0 | 0 | 0 | 0 | 0 | 0 | 0 | 0 |
| BRACE20034310 | 0 | 0 | 0 | 100 | 0 | 0 | 0 | 0 | 0 | 0 | 0 | 0 | 0 |
| BRACE20035160 | 0 | 0 | 0 | 100 | 0 | 0 | 0 | 0 | 0 | 0 | 0 | 0 | 0 |
| BRACE20035940 | 0 | 0 | 0 | 2.721 | 0 | 0 | 0 | 0 | 0 | 0 | 0 | 0 | 0 |
| BRACE20071380 | 0 | 0 | 0 | 100 | 0 | 0 | 0 | 0 | 0 | 0 | 0 | 0 | 0 |
| BRACE20071530 | 0 | 0 | 0 | 50.85 | 0 | 0 | 0 | 49.15 | 0 | 0 | 0 | 0 | 0 |
| BRACE20071970 | 0 | 0 | 0 | 100 | 0 | 0 | 0 | 0 | 0 | 0 | 0 | 0 | 0 |
| BRACE20072010 | 0 | 0 | 0 | 100 | 0 | 0 | 0 | 0 | 0 | 0 | 0 | 0 | 0 |
| BRACE20072320 | 0 | 0 | 0 | 100 | 0 | 0 | 0 | 0 | 0 | 0 | 0 | 0 | 0 |
| BRACE20072810 | 0 | 0 | 0 | 100 | 0 | 0 | 0 | 0 | 0 | 0 | 0 | 0 | 0 |
| BRACE20074470 | 0 | 0 | 0 | 100 | 0 | 0 | 0 | 0 | 0 | 0 | 0 | 0 | 0 |
| BRACE20075020 | 0 | 0 | 0 | 100 | 0 | 0 | 0 | 0 | 0 | 0 | 0 | 0 | 0 |
| BRACE20075270 | 0 | 0 | 0 | 100 | 0 | 0 | 0 | 0 | 0 | 0 | 0 | 0 | 0 |
| BRACE20075380 | 0 | 0 | 0 | 100 | 0 | 0 | 0 | 0 | 0 | 0 | 0 | 0 | 0 |
| BRACE20075630 | 0 | 0 | 0 | 100 | 0 | 0 | 0 | 0 | 0 | 0 | 0 | 0 | 0 |
| BRACE20076210 | 0 | 0 | 0 | 2.87 | 0 | 0 | 0 | 0 | 0 | 0 | 0 | 0 | 0 |
| BRACE20076460 | 0 | 0 | 0 | 50.907 | 0 | 49.093 | 0 | 0 | 0 | 0 | 0 | 0 | 0 |
| BRACE20076630 | 0 | 0 | 0 | 75.026 | 0 | 0 | 0 | 0 | 0 | 24.974 | 0 | 0 | 0 |
| BRACE20076850 | 0 | 0 | 0 | 100 | 0 | 0 | 0 | 0 | 0 | 0 | 0 | 0 | 0 |
| BRACE20077610 | 0 | 0 | 0 | 100 | 0 | 0 | 0 | 0 | 0 | 0 | 0 | 0 | 0 |
| BRACE20077640 | 0 | 0 | 0 | 100 | 0 | 0 | 0 | 0 | 0 | 0 | 0 | 0 | 0 |
| BRACE20077670 | 0 | 0 | 0 | 18.376 | 0 | 0 | 0 | 0 | 0 | 0 | 0 | 0 | 0 |
| BRACE20077840 | 0 | 0 | 0 | 100 | 0 | 0 | 0 | 0 | 0 | 0 | 0 | 0 | 0 |
| BRACE20078680 | 0 | 0 | 0 | 100 | 0 | 0 | 0 | 0 | 0 | 0 | 0 | 0 | 0 |
| BRACE20079020 | 0 | 0 | 0 | 40.241 | 0 | 0 | 0 | 0 | 0 | 0 | 0 | 0 | 0 |
| BRACE20079530 | 0 | 0 | 0 | 100 | 0 | 0 | 0 | 0 | 0 | 0 | 0 | 0 | 0 |
| BRACE20080970 | 0 | 0 | 0 | 13.841 | 0 | 0 | 0 | 0 | 20.658 | 0 | 0 | 0 | 0 |
| BRACE20081140 | 0 | 0 | 0 | 100 | 0 | 0 | 0 | 0 | 0 | 0 | 0 | 0 | 0 |

TABLE 21

| | | | | | | | | | | | | | |
|---|---|---|---|---|---|---|---|---|---|---|---|---|---|
| BRACE20083850 | 0 | 0 | 0 | 13.995 | 0 | 0 | 0 | 0 | 20.888 | 0 | 0 | 21.205 | 0 |
| BRACE20084430 | 0 | 0 | 0 | 100 | 0 | 0 | 0 | 0 | 0 | 0 | 0 | 0 | 0 |
| BRACE20084880 | 0 | 0 | 0 | 100 | 0 | 0 | 0 | 0 | 0 | 0 | 0 | 0 | 0 |
| BRACE20086530 | 0 | 0 | 0 | 24.161 | 0 | 0 | 0 | 0 | 0 | 0 | 0 | 0 | 0 |
| BRACE20086550 | 0 | 0 | 0 | 100 | 0 | 0 | 0 | 0 | 0 | 0 | 0 | 0 | 0 |
| BRACE20087080 | 0 | 0 | 0 | 56.896 | 0 | 0 | 0 | 0 | 0 | 0 | 0 | 43.104 | 0 |
| BRACE20087540 | 0 | 0 | 0 | 100 | 0 | 0 | 0 | 0 | 0 | 0 | 0 | 0 | 0 |
| BRACE20089600 | 0 | 0 | 0 | 100 | 0 | 0 | 0 | 0 | 0 | 0 | 0 | 0 | 0 |
| BRACE20089990 | 0 | 0 | 0 | 17.942 | 0 | 0 | 0 | 0 | 0 | 0 | 0 | 0 | 0 |
| BRACE20090140 | 0 | 0 | 0 | 100 | 0 | 0 | 0 | 0 | 0 | 0 | 0 | 0 | 0 |
| BRACE20091880 | 0 | 0 | 0 | 100 | 0 | 0 | 0 | 0 | 0 | 0 | 0 | 0 | 0 |
| BRACE20092120 | 0 | 0 | 0 | 38.389 | 0 | 0 | 0 | 0 | 0 | 0 | 0 | 0 | 0 |
| BRACE20092750 | 0 | 0 | 0 | 100 | 0 | 0 | 0 | 0 | 0 | 0 | 0 | 0 | 0 |
| BRACE20093070 | 0 | 0 | 0 | 26.36 | 0 | 0 | 0 | 0 | 0 | 26.323 | 0 | 0 | 0 |
| BRACE20093110 | 0 | 0 | 0 | 50.907 | 0 | 49.093 | 0 | 0 | 0 | 0 | 0 | 0 | 0 |
| BRACE20094370 | 0 | 0 | 0 | 100 | 0 | 0 | 0 | 0 | 0 | 0 | 0 | 0 | 0 |
| CTONG20008270 | 0 | 0 | 0 | 0 | 0 | 0 | 0 | 0 | 0 | 0 | 0 | 0 | 81.043 |
| CTONG20013200 | 0 | 0 | 0 | 0 | 0 | 0 | 0 | 0 | 0 | 0 | 31.824 | 0 | 0 |
| CTONG20020730 | 0 | 0 | 0 | 0 | 0 | 0 | 49.28 | 0 | 0 | 0 | 0 | 0 | 0 |
| CTONG20064490 | 0 | 0 | 0 | 0 | 0 | 0 | 0 | 36.973 | 0 | 0 | 0 | 0 | 0 |
| HHDPC20000950 | 0 | 0 | 0 | 0 | 0 | 0 | 2.27 | 0 | 0 | 0 | 0 | 1.779 | 0 |
| HHDPC20001150 | 0 | 0 | 0 | 0 | 7.181 | 0 | 0 | 0 | 0 | 0 | 0 | 0 | 0 |
| HHDPC20004560 | 0 | 0 | 0 | 0 | 0 | 0 | 0 | 0 | 0 | 0 | 0 | 14.647 | 0 |
| HSYRA10001780 | 0 | 0 | 0 | 0 | 0 | 6.902 | 0 | 0 | 0 | 14.294 | 0 | 0 | 0 |
| HSYRA20008280 | 0 | 0 | 0 | 0 | 2.439 | 0 | 0 | 0 | 0 | 0 | 2.512 | 2.427 | 0 |
| HSYRA20011530 | 0 | 0 | 0 | 0 | 19.869 | 0 | 0 | 0 | 0 | 0 | 0 | 0 | 0 |
| IMR3210002660 | 0 | 0 | 0 | 0 | 0 | 0 | 0 | 0 | 0 | 12.063 | 0 | 0 | 0 |
| IMR3220003020 | 0 | 0 | 0 | 0 | 0 | 0 | 0 | 0 | 0 | 4.348 | 0 | 0 | 0 |
| IMR3220009350 | 0 | 0 | 0 | 0 | 0 | 0 | 0 | 0 | 0 | 5.491 | 12.933 | 0 | 0 |
| KIDNE20003300 | 0 | 0 | 0 | 0 | 0 | 0 | 0 | 0 | 0 | 0 | 0 | 0 | 58.701 |
| KIDNE20004970 | 0 | 0 | 0 | 0 | 0 | 0 | 0 | 0 | 0 | 0 | 0 | 0 | 35.702 |
| KIDNE20005170 | 0 | 0 | 0 | 0 | 0 | 0 | 0 | 0 | 0 | 18.476 | 0 | 0 | 0 |
| KIDNE20059370 | 0 | 0 | 0 | 0 | 0 | 0 | 0 | 0 | 0 | 11.97 | 0 | 0 | 0 |
| KIDNE20068800 | 0 | 0 | 0 | 0 | 0 | 15.848 | 0 | 0 | 0 | 0 | 0 | 0 | 0 |
| KIDNE20073280 | 0 | 0 | 0 | 0 | 0 | 0 | 0 | 0 | 0 | 3.085 | 0 | 0 | 0 |
| LIVER20000370 | 0 | 0 | 0 | 0 | 0.637 | 0 | 0 | 0 | 0 | 0 | 0 | 0 | 0 |

TABLE 22

| | | | | | | | | | | | | | |
|---|---|---|---|---|---|---|---|---|---|---|---|---|---|
| MESAN20002670 | 0 | 0 | 0 | 30.348 | 0 | 0 | 0 | 0 | 0 | 0 | 0 | 0 | 0 |
| NT2NE20005170 | 0 | 0 | 0 | 0 | 0 | 38.711 | 0 | 0 | 0 | 0 | 0 | 0 | 0 |
| NT2NE20011560 | 0 | 0 | 0 | 0 | 40.251 | 0 | 0 | 0 | 0 | 0 | 0 | 0 | 0 |
| NT2NE20013640 | 0 | 0 | 0 | 0 | 0 | 0 | 0 | 0 | 0 | 0 | 50.666 | 0 | 0 |
| NT2NE20016970 | 0 | 0 | 0 | 0 | 0 | 38.711 | 0 | 0 | 0 | 0 | 0 | 0 | 0 |
| NT2RI20006710 | 0 | 0 | 0 | 0 | 0 | 1.611 | 0 | 0 | 0 | 0 | 2.619 | 0 | 0 |
| NT2RI20009740 | 0 | 0 | 0 | 0 | 0 | 0 | 0 | 9.103 | 0 | 0 | 0 | 0 | 0 |
| NT2RI20022430 | 0 | 0 | 0 | 0 | 0 | 21.469 | 0 | 0 | 0 | 0 | 0 | 0 | 0 |
| NT2RI20025300 | 0 | 0 | 0 | 0 | 0 | 0 | 0 | 24.543 | 0 | 0 | 0 | 0 | 0 |
| NT2RI20028020 | 0 | 0 | 0 | 0 | 0 | 37.52 | 0 | 0 | 0 | 0 | 0 | 0 | 0 |
| NT2RI20029260 | 0 | 0 | 0 | 0 | 0 | 0 | 0 | 0 | 0 | 0 | 0 | 27.171 | 0 |
| NT2RI20030110 | 0 | 0 | 0 | 2.704 | 0 | 0 | 0 | 0 | 0 | 0 | 0 | 0 | 0 |
| NT2RI20030510 | 0 | 0 | 0 | 0 | 0 | 0 | 0 | 0 | 7.544 | 0 | 0 | 0 | 0 |
| NT2RI20040590 | 0 | 0 | 0 | 0 | 14.174 | 0 | 0 | 0 | 0 | 0 | 0 | 0 | 0 |
| NT2RI20046060 | 0 | 0 | 0 | 6.506 | 0 | 0 | 0 | 0 | 0 | 0 | 0 | 0 | 0 |
| NT2RI20049840 | 0 | 0 | 0 | 0 | 0 | 48.905 | 0 | 0 | 0 | 0 | 0 | 0 | 0 |
| NT2RI20049850 | 0 | 0 | 0 | 0 | 25.927 | 16.425 | 0 | 0 | 0 | 0 | 0 | 0 | 0 |
| NT2RI20056470 | 0 | 0 | 0 | 0 | 0 | 0 | 0 | 0 | 0 | 0 | 0.791 | 0 | 0 |
| NT2RI20060720 | 0 | 0 | 0 | 0 | 0 | 0 | 0 | 34.563 | 0 | 0 | 0 | 0 | 0 |
| NT2RI20062100 | 0 | 0 | 0 | 0 | 0 | 0 | 0 | 0 | 0 | 4.348 | 0 | 0 | 0 |
| NT2RI20067350 | 0 | 0 | 0 | 0 | 0 | 0 | 0 | 0 | 0 | 27.843 | 0 | 0 | 0 |
| NT2RI20068250 | 0 | 0 | 0 | 0 | 0 | 0 | 0 | 0 | 0 | 0 | 0 | 60.06 | 0 |
| NT2RI20070840 | 0 | 0 | 0 | 0 | 0 | 0 | 0 | 0 | 8.203 | 0 | 0 | 0 | 0 |
| NT2RI20070960 | 0 | 0 | 0 | 0 | 60.173 | 0 | 0 | 0 | 0 | 0 | 0 | 0 | 0 |
| NT2RI20071480 | 0 | 0 | 0 | 0 | 0 | 7.713 | 0 | 0 | 0 | 0 | 0 | 0 | 33.576 |
| NT2RI20072540 | 0 | 0 | 0 | 0 | 0 | 0 | 0 | 20.831 | 0 | 0 | 0 | 0 | 0 |
| NT2RI20074980 | 0 | 0 | 0 | 0 | 0 | 0 | 0 | 0 | 0 | 0 | 0 | 0 | 5.656 |
| NT2RI20085260 | 0 | 0 | 0 | 0 | 0 | 0 | 0 | 0 | 0 | 1.73 | 0 | 0 | 0 |
| NT2RI20088120 | 0 | 0 | 0 | 0 | 0 | 14.618 | 0 | 0 | 0 | 0 | 0 | 22.966 | 0 |
| NT2RI20090660 | 0 | 0 | 0 | 5.633 | 0 | 0 | 0 | 5.445 | 0 | 11.251 | 0 | 0 | 0 |
| NT2RI20090830 | 0 | 0 | 0 | 0 | 0 | 23.893 | 0 | 0 | 0 | 0 | 0 | 0 | 0 |
| NT2RP70013060 | 0 | 0 | 0 | 0 | 0 | 0 | 0 | 0 | 50.126 | 0 | 0 | 0 | 0 |
| NT2RP70013350 | 0 | 0 | 0 | 0 | 0 | 0 | 0 | 19.67 | 22.78 | 10.161 | 7.978 | 0 | 0 |
| NT2RP70023760 | 0 | 0 | 0 | 0 | 0 | 0 | 0 | 0 | 0 | 0 | 0 | 0 | 50.521 |
| NT2RP70024500 | 0 | 0 | 0 | 0 | 0 | 0 | 0 | 0 | 0 | 26.32 | 0 | 0 | 0 |
| NT2RP70030910 | 0 | 0 | 0 | 0 | 0 | 0 | 0 | 0 | 0 | 6.997 | 21.973 | 0 | 0 |

TABLE 23

| | | | | | | | | | | | | | |
|---|---|---|---|---|---|---|---|---|---|---|---|---|---|
| NT2RP70036320 | 0 | 0 | 0 | 0 | 0 | 5.755 | 0 | 0 | 0 | 5.959 | 0 | 0 | 0 |
| NT2RP70036470 | 0 | 0 | 0 | 0 | 0 | 0 | 0 | 0 | 25.125 | 16.811 | 0 | 0 | 0 |
| NT2RP70042330 | 0 | 0 | 0 | 0 | 0 | 0 | 0 | 39.426 | 0 | 0 | 0 | 0 | 0 |
| NT2RP70054930 | 0 | 0 | 0 | 0 | 50.62 | 0 | 0 | 0 | 0 | 0 | 0 | 0 | 0 |
| NT2RP70064900 | 0 | 0 | 0 | 0 | 0 | 0 | 0 | 0 | 0 | 0 | 0 | 33.469 | 0 |
| NT2RP70071140 | 0 | 0 | 0 | 0 | 0 | 0 | 0 | 0 | 16.656 | 0 | 0 | 0 | 0 |
| NT2RP70075370 | 0 | 0 | 0 | 0 | 0 | 0 | 0 | 0 | 0 | 3.241 | 0 | 0 | 0 |
| NT2RP70076100 | 0 | 0 | 0 | 8.084 | 0 | 0 | 0 | 7.814 | 0 | 0 | 0 | 0 | 0 |
| NT2RP70079750 | 0 | 0 | 0 | 6.271 | 0 | 2.016 | 0 | 0 | 0 | 0 | 0 | 0 | 0 |
| NT2RP70081370 | 0 | 0 | 0 | 0 | 0 | 0 | 0 | 0 | 0 | 0 | 0 | 0 | 73.871 |
| NT2RP70090120 | 0 | 0 | 0 | 0 | 0 | 0 | 0 | 0 | 0 | 0 | 0 | 50.503 | 0 |
| NT2RP70091490 | 0 | 0 | 0 | 0 | 50.62 | 0 | 0 | 0 | 0 | 0 | 0 | 0 | 0 |
| NT2RP70093730 | 0 | 0 | 0 | 0 | 0 | 19.45 | 0 | 0 | 0 | 0 | 0 | 0 | 0 |
| NTONG20014280 | 0 | 0 | 0 | 0 | 0 | 23.698 | 0 | 0 | 0 | 0 | 0 | 0 | 0 |
| NTONG20015500 | 0 | 0 | 0 | 0 | 0 | 0 | 0 | 0 | 0 | 16.897 | 0 | 0 | 0 |
| PEBLM10000340 | 0 | 0 | 0 | 0 | 0 | 23.344 | 0 | 0 | 0 | 0 | 0 | 0 | 0 |
| PLACE60014430 | 0 | 0 | 0 | 0 | 0 | 0 | 0 | 0 | 0 | 3.198 | 0 | 0 | 0 |
| PLACE60020840 | 0 | 0 | 0 | 0 | 0 | 0 | 0 | 0 | 0 | 1.807 | 0 | 0 | 0 |
| PLACE60024190 | 0 | 0 | 0 | 0 | 0 | 18.179 | 0 | 0 | 0 | 0 | 0 | 0 | 0 |
| PLACE60026920 | 0 | 0 | 0 | 0 | 0 | 39.559 | 0 | 0 | 0 | 0 | 0 | 0 | 0 |
| PLACE60030380 | 0 | 0 | 0 | 0 | 0 | 31.763 | 0 | 0 | 0 | 0 | 0 | 0 | 0 |
| PLACE60038500 | 0 | 0 | 0 | 0 | 0 | 0 | 0 | 0 | 0 | 0 | 0 | 33.856 | 0 |
| PLACE60043970 | 0 | 0 | 0 | 0 | 13.149 | 0 | 0 | 8.349 | 12.892 | 0 | 6.772 | 0 | 0 |
| PROST10002720 | 0 | 0 | 0 | 40.095 | 0 | 0 | 0 | 0 | 0 | 0 | 0 | 0 | 0 |
| PROST20000530 | 0 | 0 | 0 | 0 | 11.605 | 0 | 0 | 0 | 0 | 0 | 0 | 0 | 0 |
| PROST20021620 | 0 | 0 | 0 | 0 | 0 | 39.227 | 0 | 0 | 0 | 0 | 0 | 0 | 0 |
| PROST20032320 | 0 | 0 | 0 | 8.436 | 0 | 4.068 | 0 | 0 | 6.295 | 8.424 | 6.614 | 0 | 0 |
| PROST20033380 | 0 | 0 | 0 | 40.252 | 0 | 0 | 0 | 9.726 | 0 | 0 | 0 | 0 | 0 |
| PROST20062600 | 0 | 0 | 0 | 0 | 0 | 0 | 0 | 0 | 0 | 13.599 | 0 | 0 | 0 |
| SALGL10000050 | 0 | 0 | 0 | 0 | 0 | 0 | 0 | 0 | 0 | 0 | 0 | 1.103 | 0 |
| SALGL10001570 | 0 | 0 | 0 | 0 | 0 | 0 | 0 | 0 | 0 | 1.042 | 0 | 0 | 0 |
| SKMUS10000220 | 0 | 0 | 0 | 3.263 | 0 | 0 | 0 | 6.308 | 9.741 | 0 | 5.117 | 0 | 0 |
| SKMUS20001170 | 0 | 0 | 0 | 0 | 33.898 | 0 | 0 | 0 | 0 | 0 | 0 | 0 | 0 |
| SKMUS20002710 | 0 | 0 | 0 | 14.288 | 0 | 0 | 0 | 0 | 0 | 0 | 0 | 43.297 | 0 |
| SKMUS20009540 | 0 | 0 | 0 | 5.866 | 0 | 0 | 0 | 5.67 | 0 | 0 | 9.198 | 8.888 | 0 |
| SKMUS20011290 | 0 | 0 | 0 | 0 | 0 | 17.838 | 0 | 0 | 0 | 0 | 0 | 0 | 0 |

TABLE 24

| | | | | | | | | | | | | | |
|---|---|---|---|---|---|---|---|---|---|---|---|---|---|
| SKMUS20015010 | 0 | 0 | 0 | 11.766 | 0 | 0 | 0 | 0 | 0 | 0 | 0 | 0 | 0 |
| SKMUS20015430 | 0 | 0 | 0 | 25.198 | 0 | 0 | 0 | 0 | 0 | 0 | 0 | 0 | 0 |
| SKMUS20016340 | 0 | 0 | 0 | 0 | 7.379 | 0 | 0 | 0 | 7.234 | 0 | 0 | 0 | 0 |
| SKNMC20002240 | 0 | 0 | 0 | 0 | 0 | 4.105 | 0 | 0 | 0 | 0 | 0 | 0 | 0 |
| SKNMC20015030 | 0 | 0 | 0 | 0 | 0 | 6.882 | 0 | 0 | 0 | 0 | 0 | 5.406 | 0 |
| SKNSH20001510 | 0 | 0 | 0 | 27.517 | 0 | 0 | 0 | 0 | 0 | 0 | 0 | 0 | 0 |
| SMINT10001000 | 0 | 0 | 0 | 0 | 0 | 39.345 | 0 | 0 | 0 | 0 | 0 | 0 | 0 |
| SMINT20002390 | 0 | 0 | 0 | 0 | 0 | 0 | 0 | 0 | 0 | 0 | 0 | 24.589 | 0 |
| SPLEN20001970 | 0 | 0 | 0 | 0 | 0 | 0 | 0 | 0 | 0 | 0 | 0 | 0 | 85.137 |
| STOMA20001210 | 0 | 0 | 0 | 0 | 0 | 0 | 0 | 0 | 0 | 0 | 0 | 0 | 6.045 |
| STOMA20002570 | 0 | 0 | 0 | 0 | 0 | 0 | 0 | 0 | 0 | 0 | 13.006 | 0 | 0 |
| SYNOV20002910 | 0 | 0 | 0 | 0 | 0 | 0 | 0 | 0 | 0 | 44.213 | 0 | 0 | 0 |
| SYNOV20011440 | 0 | 0 | 0 | 2.737 | 0 | 0 | 0 | 0 | 0 | 0 | 12.876 | 4.147 | 11.491 |
| TESTI10000510 | 0 | 0 | 0 | 0 | 0 | 0 | 0 | 0 | 0 | 7.619 | 0 | 0 | 0 |
| TESTI10000700 | 0 | 0 | 0 | 0 | 0 | 16.555 | 0 | 0 | 0 | 17.143 | 0 | 0 | 0 |
| TESTI10001680 | 0 | 0 | 0 | 0 | 0 | 8.261 | 0 | 0 | 0 | 0 | 0 | 0 | 0 |
| TESTI20005200 | 0 | 0 | 0 | 0 | 0 | 0 | 0 | 0 | 0 | 0 | 0 | 38.018 | 0 |
| TESTI20015110 | 0 | 0 | 0 | 0 | 0 | 21.276 | 0 | 0 | 0 | 0 | 0 | 0 | 0 |
| TESTI20018290 | 0 | 0 | 0 | 0 | 0 | 0 | 0 | 7.673 | 0 | 0 | 0 | 0 | 0 |
| TESTI20018690 | 0 | 0 | 0 | 0 | 0 | 0 | 0 | 61.764 | 0 | 0 | 0 | 0 | 0 |
| TESTI20018980 | 0 | 0 | 0 | 0 | 0 | 0 | 0 | 0 | 0 | 62.532 | 0 | 0 | 0 |
| TESTI20024670 | 0 | 0 | 0 | 0 | 0 | 0 | 0 | 0 | 0 | 0 | 0 | 25.049 | 0 |
| TESTI20032800 | 0 | 0 | 0 | 11.93 | 36.321 | 0 | 0 | 23.061 | 0 | 0 | 0 | 0 | 0 |
| TESTI20033250 | 0 | 0 | 0 | 18.795 | 0 | 0 | 0 | 0 | 0 | 0 | 0 | 0 | 0 |
| TESTI20036250 | 0 | 0 | 0 | 0 | 0 | 0 | 0 | 0 | 0 | 0 | 0 | 16.219 | 0 |
| TESTI20136910 | 0 | 0 | 0 | 0 | 0 | 0 | 0 | 61.764 | 0 | 0 | 0 | 0 | 0 |
| THYMU10000830 | 0 | 0 | 0 | 0 | 0 | 8.566 | 0 | 0 | 0 | 0 | 0 | 0 | 0 |
| THYMU10003290 | 0 | 0 | 0 | 0 | 0 | 0 | 0 | 0 | 33.614 | 0 | 0 | 0 | 0 |
| THYMU10003590 | 0 | 0 | 0 | 0 | 0 | 0 | 0 | 0 | 0 | 0 | 0 | 3.029 | 0 |
| UTERU10000960 | 0 | 0 | 0 | 0 | 0 | 0 | 0 | 0 | 0 | 0 | 49.42 | 0 | 0 |
| UTERU20005690 | 0 | 0 | 0 | 0 | 0 | 0 | 0 | 0 | 0 | 0 | 49.42 | 0 | 0 |
| ADRGL10000650 | 48.889 | 0 | 0 | 0 | 0 | 0 | 0 | 0 | 0 | 0 | 0 | 0 | 0 |
| BGGI120010970 | 2.298 | 0 | 0 | 0 | 0 | 2.847 | 0 | 0 | 0 | 0 | 0 | 0 | 0 |
| BRACE20004210 | 1.899 | 0 | 0 | 2.44 | 0 | 0 | 0 | 0 | 0 | 0 | 0 | 0 | 0 |
| BRACE20020500 | 9.224 | 0 | 0 | 23.701 | 0 | 0 | 0 | 11.454 | 17.687 | 0 | 0 | 0 | 0 |
| BRACE20020910 | 10.127 | 0 | 0 | 13.011 | 0 | 0 | 0 | 0 | 0 | 0 | 0 | 0 | 0 |

TABLE 25

| | | | | | | | | | | | | | |
|---|---|---|---|---|---|---|---|---|---|---|---|---|---|
| BRACE20024780 | 28.014 | 0 | 0 | 71.986 | 0 | 0 | 0 | 0 | 0 | 0 | 0 | 0 | 0 |
| BRACE20028610 | 2.126 | 0 | 0 | 2.732 | 0 | 0 | 0 | 0 | 0 | 0 | 0 | 0 | 0 |
| BRACE20031100 | 43.768 | 0 | 0 | 56.232 | 0 | 0 | 0 | 0 | 0 | 0 | 0 | 0 | 0 |
| BRACE20035270 | 9.11 | 0 | 0 | 11.704 | 0 | 0 | 0 | 5.656 | 0 | 0 | 9.176 | 0 | 0 |
| BRACE20035390 | 13.023 | 0 | 0 | 16.732 | 0 | 0 | 0 | 0 | 0 | 0 | 0 | 0 | 70.246 |
| BRACE20071740 | 21.571 | 0 | 0 | 27.714 | 0 | 0 | 0 | 0 | 0 | 0 | 0 | 0 | 0 |
| BRACE20077270 | 23.581 | 0 | 0 | 30.297 | 46.122 | 0 | 0 | 0 | 0 | 0 | 0 | 0 | 0 |
| BRAWH20001090 | 31.981 | 0 | 0 | 0 | 0 | 0 | 68.019 | 0 | 0 | 0 | 0 | 0 | 0 |
| CTONG20024530 | 18.811 | 0 | 0 | 0 | 0 | 0 | 0 | 0 | 0 | 0 | 0 | 0 | 0 |
| CTONG20028200 | 44.214 | 0 | 0 | 0 | 0 | 0 | 0 | 0 | 0 | 0 | 0 | 0 | 0 |
| CTONG20055530 | 30.136 | 0 | 0 | 0 | 0 | 0 | 0 | 0 | 0 | 0 | 0 | 0 | 0 |
| FCBBF10005980 | 100 | 0 | 0 | 0 | 0 | 0 | 0 | 0 | 0 | 0 | 0 | 0 | 0 |
| FCBBF10006180 | 100 | 0 | 0 | 0 | 0 | 0 | 0 | 0 | 0 | 0 | 0 | 0 | 0 |
| FCBBF10006870 | 100 | 0 | 0 | 0 | 0 | 0 | 0 | 0 | 0 | 0 | 0 | 0 | 0 |
| FCBBF10006910 | 100 | 0 | 0 | 0 | 0 | 0 | 0 | 0 | 0 | 0 | 0 | 0 | 0 |
| FCBBF10007320 | 100 | 0 | 0 | 0 | 0 | 0 | 0 | 0 | 0 | 0 | 0 | 0 | 0 |
| FCBBF10007600 | 8.367 | 0 | 0 | 0 | 0 | 0 | 3.559 | 0 | 0 | 0 | 0 | 0 | 0 |
| FCBBF20000940 | 100 | 0 | 0 | 0 | 0 | 0 | 0 | 0 | 0 | 0 | 0 | 0 | 0 |
| FCBBF20001050 | 100 | 0 | 0 | 0 | 0 | 0 | 0 | 0 | 0 | 0 | 0 | 0 | 0 |
| FCBBF20001950 | 34.637 | 0 | 0 | 0 | 0 | 0 | 0 | 0 | 0 | 0 | 0 | 0 | 0 |
| FCBBF20002320 | 100 | 0 | 0 | 0 | 0 | 0 | 0 | 0 | 0 | 0 | 0 | 0 | 0 |
| FCBBF20002760 | 100 | 0 | 0 | 0 | 0 | 0 | 0 | 0 | 0 | 0 | 0 | 0 | 0 |
| FCBBF20005760 | 100 | 0 | 0 | 0 | 0 | 0 | 0 | 0 | 0 | 0 | 0 | 0 | 0 |
| FCBBF20005910 | 8.519 | 0 | 0 | 0 | 0 | 0 | 0 | 0 | 0 | 0 | 0 | 0 | 0 |
| FCBBF20006770 | 100 | 0 | 0 | 0 | 0 | 0 | 0 | 0 | 0 | 0 | 0 | 0 | 0 |
| FCBBF20007330 | 33.171 | 0 | 0 | 0 | 0 | 0 | 0 | 0 | 0 | 0 | 66.829 | 0 | 0 |
| FCBBF20008080 | 100 | 0 | 0 | 0 | 0 | 0 | 0 | 0 | 0 | 0 | 0 | 0 | 0 |
| FCBBF20008150 | 100 | 0 | 0 | 0 | 0 | 0 | 0 | 0 | 0 | 0 | 0 | 0 | 0 |
| FCBBF20009400 | 23.045 | 0 | 0 | 14.804 | 0 | 0 | 0 | 0 | 0 | 0 | 0 | 62.152 | 0 |
| FCBBF20009510 | 100 | 0 | 0 | 0 | 0 | 0 | 0 | 0 | 0 | 0 | 0 | 0 | 0 |
| FCBBF20012110 | 14.958 | 0 | 0 | 0 | 0 | 18.533 | 0 | 18.575 | 0 | 0 | 0 | 0 | 0 |
| FCBBF20012990 | 100 | 0 | 0 | 0 | 0 | 0 | 0 | 0 | 0 | 0 | 0 | 0 | 0 |
| FCBBF20014800 | 44.606 | 0 | 0 | 0 | 0 | 0 | 0 | 55.394 | 0 | 0 | 0 | 0 | 0 |
| FCBBF20016720 | 100 | 0 | 0 | 0 | 0 | 0 | 0 | 0 | 0 | 0 | 0 | 0 | 0 |
| FCBBF20017180 | 100 | 0 | 0 | 0 | 0 | 0 | 0 | 0 | 0 | 0 | 0 | 0 | 0 |
| FCBBF20017200 | 100 | 0 | 0 | 0 | 0 | 0 | 0 | 0 | 0 | 0 | 0 | 0 | 0 |

TABLE 26

| | | | | | | | | | | | | | |
|---|---|---|---|---|---|---|---|---|---|---|---|---|---|
| FCBBF40002820 | 100 | 0 | 0 | 0 | 0 | 0 | 0 | 0 | 0 | 0 | 0 | 0 | 0 |
| HCASM10001150 | 1.105 | 0 | 0 | 0 | 0 | 1.369 | 0 | 0 | 0 | 1.417 | 0 | 0 | 0 |
| HHDPC20001490 | 6.308 | 0 | 0 | 8.105 | 0 | 0 | 0 | 0 | 0 | 0 | 0 | 0 | 0 |
| HLUNG10000640 | 12.676 | 0 | 0 | 0 | 0 | 0 | 0 | 0 | 0 | 0 | 0 | 0 | 0 |
| HLUNG20003140 | 6.906 | 0 | 0 | 0 | 0 | 4.278 | 7.344 | 8.576 | 0 | 0 | 0 | 6.722 | 0 |
| HLUNG20005010 | 1.306 | 0 | 0 | 0 | 5.108 | 0 | 2.778 | 4.865 | 0 | 1.676 | 2.631 | 0 | 0 |
| HSYRA20001350 | 5.798 | 0 | 0 | 0 | 0 | 7.183 | 0 | 0 | 0 | 7.438 | 0 | 0 | 0 |
| HSYRA20014760 | 5.57 | 0 | 0 | 0 | 0 | 0 | 0 | 0 | 5.34 | 0 | 0 | 0 | 0 |
| HSYRA20016310 | 20.226 | 0 | 0 | 0 | 0 | 0 | 0 | 0 | 0 | 0 | 0 | 0 | 0 |
| IMR3220007420 | 1.259 | 0 | 0 | 1.617 | 7.386 | 0 | 0 | 0 | 0 | 0 | 0 | 0 | 0 |
| IMR3220009730 | 1.911 | 0 | 0 | 0 | 0 | 0 | 0 | 0 | 0 | 0 | 0 | 0 | 0 |
| IMR3220009840 | 5.075 | 0 | 0 | 0 | 0 | 0 | 0 | 0 | 0 | 0 | 0 | 0 | 0 |
| IMR3220012180 | 2.92 | 0 | 0 | 3.752 | 0 | 0 | 0 | 0 | 0 | 0 | 0 | 5.685 | 0 |
| IMR3220013320 | 1.349 | 0 | 0 | 3.466 | 0 | 0 | 0 | 0 | 0 | 0 | 0 | 2.626 | 0 |
| KIDNE20002660 | 3.71 | 0 | 0 | 9.532 | 0 | 4.596 | 0 | 0 | 0 | 0 | 14.947 | 0 | 0 |
| KIDNE20056760 | 25.852 | 0 | 0 | 0 | 0 | 0 | 0 | 0 | 0 | 0 | 0 | 0 | 0 |
| KIDNE20073520 | 4.679 | 0 | 0 | 8.016 | 0 | 0 | 6.635 | 0 | 0 | 10.006 | 0 | 0 | 0 |
| LIVER20004160 | 7.091 | 0 | 0 | 0 | 0 | 0 | 15.081 | 0 | 0 | 9.098 | 0 | 13.803 | 0 |
| MESAN20000920 | 15.635 | 0 | 0 | 0 | 0 | 0 | 33.255 | 0 | 0 | 0 | 0 | 0 | 0 |
| NT2NE20015300 | 11.539 | 0 | 0 | 0 | 0 | 0 | 0 | 0 | 0 | 0 | 0 | 0 | 0 |
| NT2NE20035690 | 5.488 | 0 | 0 | 0 | 0 | 6.8 | 0 | 0 | 0 | 0 | 0 | 0 | 0 |
| NT2RI20010910 | 7.537 | 0 | 0 | 0 | 0 | 0 | 0 | 0 | 0 | 0 | 0 | 0 | 0 |
| NT2RI20016210 | 8.216 | 0 | 0 | 0 | 0 | 0 | 17.474 | 0 | 0 | 0 | 16.552 | 0 | 0 |
| NT2RI20016570 | 1.129 | 0 | 0 | 0 | 0 | 0 | 0 | 0 | 2.165 | 0 | 0 | 0 | 0 |
| NT2RI20033040 | 0.876 | 0 | 0 | 0 | 0 | 0 | 1.863 | 0 | 0 | 0 | 1.764 | 0 | 0 |
| NT2RI20033440 | 24.272 | 0 | 0 | 0 | 0 | 0 | 0 | 0 | 0 | 0 | 0 | 0 | 0 |
| NT2RI20058110 | 6.517 | 0 | 0 | 0 | 0 | 4.037 | 0 | 0 | 6.248 | 0 | 0 | 0 | 0 |
| NT2RI20065060 | 43.582 | 0 | 0 | 0 | 0 | 0 | 0 | 0 | 0 | 0 | 0 | 0 | 0 |
| NT2RI20087490 | 1.493 | 0 | 0 | 0 | 0 | 0 | 1.587 | 1.853 | 0 | 0 | 1.503 | 0 | 4.025 |
| NT2RP60000720 | 1.537 | 0 | 0 | 0 | 0 | 0 | 0 | 0 | 2.947 | 0 | 0 | 0 | 0 |
| NT2RP70002710 | 7.63 | 0 | 0 | 0 | 0 | 9.454 | 0 | 0 | 14.632 | 9.79 | 0 | 14.854 | 0 |
| NT2RP70012310 | 51.164 | 0 | 0 | 0 | 0 | 0 | 0 | 0 | 0 | 0 | 0 | 0 | 0 |
| NT2RP70036800 | 6.873 | 0 | 0 | 0 | 0 | 0 | 7.309 | 4.267 | 6.589 | 0 | 13.846 | 0 | 0 |
| NT2RP70055020 | 2.574 | 0 | 0 | 0 | 0 | 0 | 5.475 | 0 | 0 | 0 | 0 | 0 | 0 |
| NT2RP70055130 | 1.702 | 0 | 0 | 0 | 0 | 0 | 0 | 0 | 0 | 2.184 | 0 | 0 | 0 |
| NT2RP70061880 | 10.819 | 0 | 0 | 0 | 0 | 0 | 0 | 0 | 0 | 0 | 0 | 0 | 0 |

TABLE 27

| | | | | | | | | | | | | | |
|---|---|---|---|---|---|---|---|---|---|---|---|---|---|
| NT2RP70084410 | 34.389 | 0 | 0 | 0 | 0 | 0 | 0 | 0 | 0 | 0 | 0 | 0 | 0 |
| PLACE60037450 | 2.922 | 0 | 0 | 0 | 0 | 0 | 0 | 0 | 0 | 3.749 | 0 | 0 | 15.76 |
| PLACE60049310 | 10.959 | 0 | 0 | 0 | 0 | 0 | 0 | 0 | 0 | 0 | 0 | 0 | 0 |
| PROST10005260 | 6.046 | 0 | 0 | 0 | 0 | 0 | 12.858 | 7.508 | 0 | 0 | 0 | 0 | 0 |
| PROST20018230 | 34.251 | 0 | 0 | 0 | 0 | 0 | 0 | 0 | 0 | 0 | 0 | 0 | 0 |
| PROST20051430 | 16.176 | 0 | 0 | 0 | 0 | 0 | 0 | 0 | 0 | 0 | 0 | 0 | 0 |
| SKMUS20000740 | 9.448 | 0 | 0 | 0 | 18.48 | 0 | 0 | 0 | 0 | 0 | 0 | 0 | 0 |
| SKMUS20011470 | 11.578 | 0 | 0 | 0 | 0 | 0 | 0 | 0 | 0 | 0 | 0 | 0 | 0 |
| SKNMC20003560 | 3.771 | 0 | 0 | 0 | 0 | 0 | 0 | 0 | 0 | 0 | 0 | 0 | 0 |
| SKNSH20001630 | 19.559 | 0 | 0 | 0 | 0 | 0 | 0 | 0 | 0 | 0 | 0 | 0 | 0 |
| SPLEN10000490 | 51.503 | 0 | 0 | 0 | 0 | 0 | 0 | 0 | 0 | 0 | 0 | 0 | 0 |
| STOMA20002890 | 0.658 | 0 | 0 | 1.692 | 3.864 | 2.448 | 0 | 4.906 | 2.525 | 0.845 | 0 | 2.564 | 0 |
| SYNOV20013740 | 5.862 | 0 | 0 | 0 | 0 | 0 | 0 | 0 | 0 | 0 | 0 | 0 | 0 |
| TESTI20011410 | 21.79 | 0 | 0 | 0 | 0 | 0 | 0 | 0 | 0 | 27.957 | 0 | 0 | 0 |
| TESTI20033760 | 32.749 | 0 | 0 | 42.075 | 0 | 0 | 0 | 0 | 0 | 0 | 0 | 0 | 0 |
| TESTI20074640 | 6.367 | 0 | 0 | 0 | 0 | 0 | 0 | 0 | 0 | 0 | 0 | 0 | 0 |
| TRACH10000300 | 11.784 | 0 | 0 | 0 | 0 | 0 | 12.532 | 0 | 0 | 0 | 0 | 0 | 0 |
| TRACH20013950 | 6.119 | 0 | 0 | 0 | 0 | 7.582 | 0 | 0 | 0 | 0 | 0 | 0 | 0 |
| 3NB6920003300 | 0 | 2.236 | 0 | 2.115 | 1.073 | 0.68 | 0 | 0 | 0 | 0 | 2.211 | 2.136 | 0 |
| 3NB6920009120 | 0 | 2.076 | 0 | 7.854 | 0 | 0 | 0 | 0 | 0 | 0 | 3.079 | 0 | 0 |
| ADRGL10000180 | 0 | 11.553 | 0 | 32.778 | 0 | 0 | 18.087 | 0 | 0 | 10.911 | 0 | 0 | 0 |
| BRACE10001150 | 0 | 0.896 | 0 | 5.51 | 7.743 | 0.409 | 3.508 | 1.639 | 0 | 0 | 2.658 | 3.211 | 0 |
| BRACE10001590 | 0 | 1.786 | 0 | 3.378 | 5.142 | 0 | 0 | 3.265 | 0 | 0 | 0 | 0 | 0 |
| BRACE10001690 | 0 | 26.07 | 0 | 49.31 | 0 | 0 | 0 | 0 | 0 | 24.62 | 0 | 0 | 0 |
| BRACE20077680 | 0 | 61.348 | 0 | 19.339 | 0 | 0 | 0 | 0 | 0 | 19.312 | 0 | 0 | 0 |
| BRACE20092740 | 0 | 7.585 | 0 | 7.173 | 0 | 0 | 0 | 6.933 | 0 | 0 | 0 | 0 | 0 |
| BRACE20093610 | 0 | 34.081 | 0 | 16.116 | 24.533 | 0 | 0 | 0 | 0 | 0 | 25.27 | 0 | 0 |
| BRACE20095170 | 0 | 8.101 | 0 | 22.983 | 0 | 7.388 | 0 | 0 | 0 | 7.65 | 0 | 0 | 0 |
| BRAWH20011410 | 0 | 9.604 | 0 | 27.247 | 0 | 0 | 15.035 | 0 | 0 | 0 | 0 | 0 | 0 |
| BRAWH20036930 | 0 | 6.779 | 0 | 12.822 | 0 | 0 | 10.613 | 0 | 0 | 0 | 10.053 | 0 | 0 |
| BRAWH20064500 | 0 | 8.436 | 0 | 0 | 0 | 0 | 52.827 | 7.711 | 0 | 0 | 0 | 0 | 0 |
| BRAWH20087060 | 0 | 11.947 | 0 | 0 | 0 | 0 | 37.407 | 0 | 0 | 33.848 | 0 | 0 | 0 |
| CTONG20019110 | 0 | 51.848 | 0 | 0 | 0 | 0 | 0 | 0 | 0 | 0 | 0 | 0 | 0 |
| FEBRA20000350 | 0 | 100 | 0 | 0 | 0 | 0 | 0 | 0 | 0 | 0 | 0 | 0 | 0 |
| FEBRA20000530 | 0 | 51.43 | 0 | 0 | 0 | 0 | 0 | 0 | 0 | 48.57 | 0 | 0 | 0 |
| FEBRA20001050 | 0 | 26.32 | 0 | 0 | 0 | 0 | 0 | 0 | 0 | 0 | 0 | 0 | 0 |

TABLE 28

| | | | | | | | | | | | | | |
|---|---|---|---|---|---|---|---|---|---|---|---|---|---|
| FEBRA20001290 | 0 | 2.84 | 0 | 0 | 0 | 0 | 0 | 0 | 0 | 0 | 0 | 0 | 0 |
| FEBRA20003110 | 0 | 56.251 | 0 | 0 | 0 | 0 | 0 | 0 | 0 | 0 | 0 | 0 | 0 |
| FEBRA20003300 | 0 | 61.348 | 0 | 19.339 | 0 | 0 | 0 | 0 | 0 | 19.312 | 0 | 0 | 0 |
| FEBRA20003780 | 0 | 100 | 0 | 0 | 0 | 0 | 0 | 0 | 0 | 0 | 0 | 0 | 0 |
| FEBRA20003910 | 0 | 100 | 0 | 0 | 0 | 0 | 0 | 0 | 0 | 0 | 0 | 0 | 0 |
| FEBRA20003970 | 0 | 24.941 | 0 | 0 | 0 | 0 | 39.046 | 0 | 0 | 0 | 0 | 0 | 0 |
| FEBRA20003990 | 0 | 100 | 0 | 0 | 0 | 0 | 0 | 0 | 0 | 0 | 0 | 0 | 0 |
| FEBRA20004040 | 0 | 100 | 0 | 0 | 0 | 0 | 0 | 0 | 0 | 0 | 0 | 0 | 0 |
| FEBRA20004150 | 0 | 100 | 0 | 0 | 0 | 0 | 0 | 0 | 0 | 0 | 0 | 0 | 0 |
| FEBRA20004540 | 0 | 30.224 | 0 | 0 | 0 | 0 | 0 | 0 | 0 | 0 | 0 | 0 | 0 |
| FEBRA20004910 | 0 | 100 | 0 | 0 | 0 | 0 | 0 | 0 | 0 | 0 | 0 | 0 | 0 |
| FEBRA20006560 | 0 | 100 | 0 | 0 | 0 | 0 | 0 | 0 | 0 | 0 | 0 | 0 | 0 |
| FEBRA20006800 | 0 | 18.007 | 0 | 0 | 0 | 0 | 0 | 0 | 0 | 0 | 0 | 0 | 0 |
| FEBRA20006900 | 0 | 100 | 0 | 0 | 0 | 0 | 0 | 0 | 0 | 0 | 0 | 0 | 0 |
| FEBRA20007330 | 0 | 27.886 | 0 | 0 | 0 | 0 | 0 | 12.745 | 0 | 0 | 0 | 0 | 0 |
| FEBRA20007400 | 0 | 2.356 | 0 | 0 | 0 | 0 | 3.689 | 0 | 0 | 0 | 0 | 3.376 | 0 |
| FEBRA20007710 | 0 | 100 | 0 | 0 | 0 | 0 | 0 | 0 | 0 | 0 | 0 | 0 | 0 |
| FEBRA20007720 | 0 | 52.244 | 0 | 0 | 0 | 0 | 0 | 47.756 | 0 | 0 | 0 | 0 | 0 |
| FEBRA20007870 | 0 | 11.14 | 0 | 10.535 | 0 | 30.48 | 0 | 0 | 15.724 | 0 | 0 | 0 | 0 |
| FEBRA20008090 | 0 | 51.395 | 0 | 48.605 | 0 | 0 | 0 | 0 | 0 | 0 | 0 | 0 | 0 |
| FEBRA20008560 | 0 | 46.91 | 0 | 0 | 0 | 0 | 0 | 0 | 0 | 0 | 0 | 0 | 0 |
| FEBRA20008800 | 0 | 19.721 | 0 | 18.651 | 0 | 0 | 0 | 18.027 | 0 | 0 | 0 | 0 | 0 |
| FEBRA20008810 | 0 | 6.596 | 0 | 0 | 0 | 0 | 0 | 0 | 0 | 0 | 0 | 0 | 0 |
| FEBRA20009590 | 0 | 100 | 0 | 0 | 0 | 0 | 0 | 0 | 0 | 0 | 0 | 0 | 0 |
| FEBRA20009720 | 0 | 27.255 | 0 | 0 | 0 | 0 | 0 | 0 | 0 | 0 | 0 | 0 | 0 |
| FEBRA20010930 | 0 | 100 | 0 | 0 | 0 | 0 | 0 | 0 | 0 | 0 | 0 | 0 | 0 |
| FEBRA20011330 | 0 | 100 | 0 | 0 | 0 | 0 | 0 | 0 | 0 | 0 | 0 | 0 | 0 |
| FEBRA20011460 | 0 | 100 | 0 | 0 | 0 | 0 | 0 | 0 | 0 | 0 | 0 | 0 | 0 |
| FEBRA20012270 | 0 | 42.467 | 0 | 0 | 0 | 0 | 0 | 0 | 19.98 | 13.369 | 0 | 0 | 0 |
| FEBRA20012940 | 0 | 8.079 | 0 | 0 | 0 | 0 | 0 | 0 | 0 | 0 | 0 | 0 | 0 |
| FEBRA20013510 | 0 | 100 | 0 | 0 | 0 | 0 | 0 | 0 | 0 | 0 | 0 | 0 | 0 |
| FEBRA20014870 | 0 | 100 | 0 | 0 | 0 | 0 | 0 | 0 | 0 | 0 | 0 | 0 | 0 |
| FEBRA20015900 | 0 | 100 | 0 | 0 | 0 | 0 | 0 | 0 | 0 | 0 | 0 | 0 | 0 |
| FEBRA20015910 | 0 | 100 | 0 | 0 | 0 | 0 | 0 | 0 | 0 | 0 | 0 | 0 | 0 |
| FEBRA20017060 | 0 | 100 | 0 | 0 | 0 | 0 | 0 | 0 | 0 | 0 | 0 | 0 | 0 |
| FEBRA20017900 | 0 | 100 | 0 | 0 | 0 | 0 | 0 | 0 | 0 | 0 | 0 | 0 | 0 |

TABLE 29

| | | | | | | | | | | | | | |
|---|---|---|---|---|---|---|---|---|---|---|---|---|---|
| FEBRA20019890 | 0 | 100 | 0 | 0 | 0 | 0 | 0 | 0 | 0 | 0 | 0 | 0 | 0 |
| FEBRA20020860 | 0 | 100 | 0 | 0 | 0 | 0 | 0 | 0 | 0 | 0 | 0 | 0 | 0 |
| FEBRA20024290 | 0 | 56.251 | 0 | 0 | 0 | 0 | 0 | 0 | 0 | 0 | 0 | 0 | 0 |
| FEBRA20024420 | 0 | 52.244 | 0 | 0 | 0 | 0 | 0 | 47.756 | 0 | 0 | 0 | 0 | 0 |
| FEBRA20027270 | 0 | 100 | 0 | 0 | 0 | 0 | 0 | 0 | 0 | 0 | 0 | 0 | 0 |
| FEBRA20027830 | 0 | 100 | 0 | 0 | 0 | 0 | 0 | 0 | 0 | 0 | 0 | 0 | 0 |
| FEBRA20028820 | 0 | 100 | 0 | 0 | 0 | 0 | 0 | 0 | 0 | 0 | 0 | 0 | 0 |
| FEBRA20028970 | 0 | 100 | 0 | 0 | 0 | 0 | 0 | 0 | 0 | 0 | 0 | 0 | 0 |
| FEBRA20029080 | 0 | 100 | 0 | 0 | 0 | 0 | 0 | 0 | 0 | 0 | 0 | 0 | 0 |
| FEBRA20030540 | 0 | 51.395 | 0 | 48.605 | 0 | 0 | 0 | 0 | 0 | 0 | 0 | 0 | 0 |
| FEBRA20031550 | 0 | 100 | 0 | 0 | 0 | 0 | 0 | 0 | 0 | 0 | 0 | 0 | 0 |
| FEBRA20033080 | 0 | 100 | 0 | 0 | 0 | 0 | 0 | 0 | 0 | 0 | 0 | 0 | 0 |
| FEBRA20034290 | 0 | 100 | 0 | 0 | 0 | 0 | 0 | 0 | 0 | 0 | 0 | 0 | 0 |
| FEBRA20037070 | 0 | 52.244 | 0 | 0 | 0 | 0 | 0 | 47.756 | 0 | 0 | 0 | 0 | 0 |
| FEBRA20041100 | 0 | 100 | 0 | 0 | 0 | 0 | 0 | 0 | 0 | 0 | 0 | 0 | 0 |
| FEBRA20041910 | 0 | 100 | 0 | 0 | 0 | 0 | 0 | 0 | 0 | 0 | 0 | 0 | 0 |
| FEBRA20042240 | 0 | 1.855 | 0 | 0 | 2.67 | 0 | 0 | 0 | 0 | 1.752 | 5.501 | 5.315 | 0 |
| FEBRA20042370 | 0 | 100 | 0 | 0 | 0 | 0 | 0 | 0 | 0 | 0 | 0 | 0 | 0 |
| FEBRA20042930 | 0 | 63.862 | 0 | 0 | 0 | 0 | 0 | 0 | 0 | 0 | 0 | 0 | 0 |
| FEBRA20043290 | 0 | 100 | 0 | 0 | 0 | 0 | 0 | 0 | 0 | 0 | 0 | 0 | 0 |
| FEBRA20044430 | 0 | 100 | 0 | 0 | 0 | 0 | 0 | 0 | 0 | 0 | 0 | 0 | 0 |
| FEBRA20044900 | 0 | 76.687 | 0 | 0 | 0 | 23.313 | 0 | 0 | 0 | 0 | 0 | 0 | 0 |
| FEBRA20045920 | 0 | 40.275 | 0 | 0 | 0 | 0 | 0 | 0 | 0 | 0 | 59.725 | 0 | 0 |
| FEBRA20048180 | 0 | 100 | 0 | 0 | 0 | 0 | 0 | 0 | 0 | 0 | 0 | 0 | 0 |
| FEBRA20050140 | 0 | 100 | 0 | 0 | 0 | 0 | 0 | 0 | 0 | 0 | 0 | 0 | 0 |
| FEBRA20050790 | 0 | 68.681 | 0 | 0 | 0 | 31.319 | 0 | 0 | 0 | 0 | 0 | 0 | 0 |
| FEBRA20052160 | 0 | 100 | 0 | 0 | 0 | 0 | 0 | 0 | 0 | 0 | 0 | 0 | 0 |
| FEBRA20053770 | 0 | 26.264 | 0 | 0 | 0 | 0 | 0 | 0 | 0 | 0 | 0 | 0 | 0 |
| FEBRA20053800 | 0 | 100 | 0 | 0 | 0 | 0 | 0 | 0 | 0 | 0 | 0 | 0 | 0 |
| FEBRA20054270 | 0 | 38.978 | 0 | 0 | 0 | 0 | 61.022 | 0 | 0 | 0 | 0 | 0 | 0 |
| FEBRA20057260 | 0 | 100 | 0 | 0 | 0 | 0 | 0 | 0 | 0 | 0 | 0 | 0 | 0 |
| FEBRA20057520 | 0 | 9.767 | 0 | 0 | 14.061 | 0 | 0 | 0 | 0 | 0 | 0 | 13.994 | 0 |
| FEBRA20059980 | 0 | 100 | 0 | 0 | 0 | 0 | 0 | 0 | 0 | 0 | 0 | 0 | 0 |
| FEBRA20060920 | 0 | 100 | 0 | 0 | 0 | 0 | 0 | 0 | 0 | 0 | 0 | 0 | 0 |
| FEBRA20061500 | 0 | 100 | 0 | 0 | 0 | 0 | 0 | 0 | 0 | 0 | 0 | 0 | 0 |
| FEBRA20062700 | 0 | 6.614 | 0 | 0 | 0 | 6.032 | 0 | 0 | 0 | 0 | 0 | 0 | 26.259 |

TABLE 30

| | | | | | | | | | | | | | |
|---|---|---|---|---|---|---|---|---|---|---|---|---|---|
| FEBRA20063150 | 0 | 100 | 0 | 0 | 0 | 0 | 0 | 0 | 0 | 0 | 0 | 0 | 0 |
| FEBRA20063540 | 0 | 100 | 0 | 0 | 0 | 0 | 0 | 0 | 0 | 0 | 0 | 0 | 0 |
| FEBRA20064760 | 0 | 100 | 0 | 0 | 0 | 0 | 0 | 0 | 0 | 0 | 0 | 0 | 0 |
| FEBRA20066670 | 0 | 100 | 0 | 0 | 0 | 0 | 0 | 0 | 0 | 0 | 0 | 0 | 0 |
| FEBRA20067360 | 0 | 29.836 | 0 | 28.216 | 0 | 0 | 0 | 0 | 0 | 0 | 0 | 0 | 0 |
| FEBRA20067930 | 0 | 41.591 | 0 | 0 | 0 | 0 | 0 | 0 | 0 | 0 | 0 | 0 | 0 |
| FEBRA20068730 | 0 | 13.327 | 0 | 0 | 0 | 0 | 0 | 6.091 | 0 | 6.293 | 0 | 0 | 0 |
| FEBRA20069420 | 0 | 100 | 0 | 0 | 0 | 0 | 0 | 0 | 0 | 0 | 0 | 0 | 0 |
| FEBRA20070170 | 0 | 58.145 | 0 | 0 | 41.855 | 0 | 0 | 0 | 0 | 0 | 0 | 0 | 0 |
| FEBRA20072000 | 0 | 100 | 0 | 0 | 0 | 0 | 0 | 0 | 0 | 0 | 0 | 0 | 0 |
| FEBRA20072800 | 0 | 25.289 | 0 | 0 | 0 | 0 | 0 | 0 | 0 | 0 | 0 | 0 | 0 |
| FEBRA20074140 | 0 | 100 | 0 | 0 | 0 | 0 | 0 | 0 | 0 | 0 | 0 | 0 | 0 |
| FEBRA20075510 | 0 | 100 | 0 | 0 | 0 | 0 | 0 | 0 | 0 | 0 | 0 | 0 | 0 |
| FEBRA20075660 | 0 | 100 | 0 | 0 | 0 | 0 | 0 | 0 | 0 | 0 | 0 | 0 | 0 |
| HSYRA20006400 | 0 | 8.487 | 0 | 0 | 0 | 10.321 | 0 | 0 | 0 | 2.672 | 0 | 0 | 11.233 |
| HSYRA20015800 | 0 | 11.901 | 0 | 0 | 0 | 0 | 0 | 0 | 0 | 0 | 0 | 0 | 0 |
| IMR3220002230 | 0 | 2.396 | 0 | 4.532 | 3.45 | 0 | 3.751 | 0 | 0 | 0 | 0 | 3.433 | 0 |
| KIDNE20005740 | 0 | 3.312 | 0 | 3.132 | 2.384 | 3.021 | 2.593 | 0 | 2.338 | 4.692 | 0 | 9.492 | 0 |
| KIDNE20053360 | 0 | 41.858 | 0 | 0 | 0 | 0 | 0 | 0 | 0 | 0 | 0 | 0 | 0 |
| NT2NE20002140 | 0 | 7.99 | 0 | 0 | 0 | 0 | 0 | 0 | 0 | 7.546 | 11.849 | 0 | 0 |
| NT2NE20003270 | 0 | 20.031 | 0 | 9.472 | 0 | 0 | 0 | 0 | 0 | 0 | 0 | 0 | 0 |
| NT2NE20003840 | 0 | 4.178 | 0 | 0 | 0 | 0 | 0 | 5.897 | 0 | 0 | 0 | 0 | 0 |
| NT2NE20007870 | 0 | 12.224 | 0 | 11.56 | 5.866 | 3.716 | 12.758 | 0 | 0 | 3.848 | 0 | 0 | 0 |
| NT2NE20047160 | 0 | 29.779 | 0 | 0 | 0 | 0 | 0 | 27.221 | 0 | 0 | 0 | 0 | 0 |
| NT2NE20053710 | 0 | 4.057 | 0 | 0 | 0 | 3.811 | 2.225 | 1.145 | 1.533 | 0 | 1.163 | 3.222 | |
| NT2RI20025410 | 0 | 12.493 | 0 | 0 | 0 | 0 | 0 | 0 | 0 | 0 | 0 | 0 | 0 |
| NT2RI20051500 | 0 | 4.83 | 0 | 0 | 0 | 6.608 | 0 | 0 | 0 | 9.123 | 3.581 | 0 | 0 |
| NT2RI20055640 | 0 | 20.676 | 0 | 0 | 29.767 | 0 | 0 | 0 | 0 | 0 | 0 | 0 | 0 |
| NT2RI20058510 | 0 | 8.776 | 0 | 0 | 0 | 16.008 | 0 | 8.022 | 0 | 0 | 0 | 0 | 0 |
| NT2RI20061830 | 0 | 67.731 | 0 | 0 | 0 | 0 | 0 | 0 | 0 | 0 | 0 | 0 | 0 |
| NT2RI20064120 | 0 | 3.043 | 0 | 2.877 | 0 | 24.975 | 4.763 | 8.344 | 4.295 | 2.873 | 0 | 0 | 0 |
| NT2RI20071330 | 0 | 4.842 | 0 | 0 | 0 | 0 | 0 | 0 | 0 | 0 | 0 | 0 | 0 |
| NT2RI20075890 | 0 | 17.093 | 0 | 4.041 | 6.152 | 0 | 13.38 | 3.906 | 0 | 0 | 12.674 | 0 | 0 |
| NT2RI20077230 | 0 | 7.683 | 0 | 0 | 0 | 7.007 | 0 | 0 | 0 | 0 | 0 | 0 | 0 |
| NT2RI20094060 | 0 | 19.011 | 0 | 0 | 0 | 0 | 0 | 0 | 0 | 0 | 0 | 13.621 | 0 |
| NT2RP70002380 | 0 | 16.014 | 0 | 0 | 0 | 0 | 0 | 0 | 0 | 0 | 23.748 | 0 | 0 |

TABLE 31

| | | | | | | | | | | | | | |
|---|---|---|---|---|---|---|---|---|---|---|---|---|---|
| NT2RP70009060 | 0 | 6.136 | 0 | 0 | 0 | 0 | 0 | 0 | 0 | 0 | 0 | 8.792 | 0 |
| NT2RP70015910 | 0 | 15.95 | 0 | 0 | 0 | 0 | 0 | 0 | 0 | 0 | 0 | 0 | 0 |
| NT2RP70094810 | 0 | 41.591 | 0 | 0 | 0 | 0 | 0 | 0 | 0 | 0 | 0 | 0 | 0 |
| NT2RP70094980 | 0 | 31.425 | 0 | 0 | 0 | 0 | 0 | 0 | 0 | 0 | 0 | 0 | 0 |
| PLACE60012810 | 0 | 10.915 | 0 | 0 | 0 | 0 | 17.088 | 0 | 0 | 0 | 0 | 0 | 0 |
| PLACE60040050 | 0 | 12.224 | 0 | 11.56 | 5.866 | 3.716 | 12.758 | 0 | 0 | 3.848 | 0 | 0 | 0 |
| SKMUS20008630 | 0 | 1.929 | 0 | 0 | 0 | 0 | 3.019 | 1.763 | 2.722 | 0 | 2.86 | 0 | 0 |
| SKNMC20003050 | 0 | 4.704 | 0 | 0 | 0 | 0 | 0 | 0 | 0 | 0 | 0 | 0 | 0 |
| SKNSH20003470 | 0 | 11.274 | 0 | 0 | 0 | 17.649 | 0 | 0 | 10.647 | 0 | 0 | 0 | 0 |
| TESTI20003560 | 0 | 32.494 | 0 | 30.73 | 0 | 0 | 0 | 0 | 0 | 0 | 0 | 0 | 0 |
| TESTI20012690 | 0 | 6.873 | 0 | 0 | 0 | 0 | 0 | 0 | 0 | 3.245 | 0 | 0 | 0 |
| TESTI20030710 | 0 | 2.471 | 0 | 2.337 | 0 | 0 | 0 | 0 | 0 | 0 | 0 | 0 | 0 |
| TESTI20082400 | 0 | 10.101 | 0 | 12.736 | 0 | 7.677 | 5.271 | 1.539 | 0 | 6.359 | 4.993 | 28.947 | 0 |
| TRACH20009260 | 0 | 10.327 | 0 | 0 | 0 | 16.167 | 0 | 0 | 0 | 15.314 | 0 | 0 | |
| 3NB6910001160 | 0 | 0 | 4.677 | 0 | 0 | 2.97 | 0 | 2.977 | 0 | 0 | 0 | 0 | 12.929 |
| 3NB6920015280 | 0 | 0 | 7.604 | 0 | 0 | 0 | 8.289 | 0 | 0 | 0 | 0 | 0 | 0 |
| BRACE10000700 | 0 | 0 | 23.494 | 15.469 | 0 | 0 | 0 | 14.952 | 0 | 0 | 0 | 0 | 0 |
| BRACE20019440 | 0 | 0 | 18.376 | 24.2 | 18.42 | 0 | 20.03 | 0 | 0 | 0 | 18.974 | 0 | 0 |
| BRAWH20052250 | 0 | 0 | 49.094 | 0 | 0 | 0 | 26.756 | 0 | 0 | 0 | 0 | 0 | 0 |
| KIDNE20045340 | 0 | 0 | 18.126 | 0 | 0 | 0 | 0 | 0 | 0 | 0 | 0 | 0 | 0 |
| NT2NE20002590 | 0 | 0 | 10.019 | 0 | 0 | 0 | 0 | 0 | 0 | 0 | 0 | 0 | 0 |
| NT2NE20014030 | 0 | 0 | 17.607 | 11.594 | 0 | 0 | 0 | 0 | 0 | 0 | 18.18 | 0 | 0 |
| NT2RI20020220 | 0 | 0 | 60.117 | 0 | 0 | 0 | 0 | 0 | 0 | 0 | 0 | 0 | 0 |
| NT2RI20026540 | 0 | 0 | 7.839 | 2.581 | 7.858 | 2.489 | 0 | 7.484 | 0 | 5.155 | 0 | 0 | 10.836 |
| NT2RI20060710 | 0 | 0 | 27.482 | 54.286 | 0 | 0 | 0 | 0 | 0 | 0 | 0 | 0 | 0 |
| NT2RI20083960 | 0 | 0 | 17.159 | 0 | 0 | 0 | 5.46 | 0 | 0 | 5.641 | 0 | 0 | 0 |
| NT2RI20084810 | 0 | 0 | 6.466 | 0 | 0 | 4.106 | 0 | 0 | 0 | 4.252 | 0 | 0 | 0 |
| NT2RP70011660 | 0 | 0 | 2.798 | 0 | 0 | 0 | 0 | 1.781 | 0 | 0 | 0 | 0 | 7.735 |
| NT2RP70021510 | 0 | 0 | 50.561 | 0 | 0 | 0 | 0 | 0 | 0 | 0 | 0 | 0 | 0 |
| NT2RP70024490 | 0 | 0 | 23.216 | 0 | 0 | 0 | 0 | 0 | 0 | 15.265 | 0 | 0 | 0 |
| NT2RP70026190 | 0 | 0 | 19.395 | 0 | 0 | 0 | 0 | 0 | 0 | 0 | 0 | 0 | 0 |
| NT2RP70039600 | 0 | 0 | 15.654 | 0 | 0 | 0 | 0 | 0 | 0 | 0 | 0 | 0 | 0 |
| NT2RP70049250 | 0 | 0 | 56.829 | 0 | 0 | 0 | 0 | 0 | 0 | 0 | 0 | 0 | 0 |
| NT2RP70071770 | 0 | 0 | 9.68 | 0 | 0 | 0 | 0 | 0 | 0 | 6.365 | 0 | 0 | 0 |
| NT2RP70093940 | 0 | 0 | 24.62 | 0 | 0 | 0 | 0 | 0 | 0 | 16.188 | 25.42 | 0 | 0 |
| NT0NG10002640 | 0 | 0 | 32.847 | 0 | 0 | 0 | 0 | 0 | 0 | 0 | 0 | 0 | 0 |

TABLE 32

| | | | | | | | | | | | | | |
|---|---|---|---|---|---|---|---|---|---|---|---|---|---|
| NTONG20002650 | 0 | 0 | 10.276 | 0 | 0 | 0 | 0 | 0 | 0 | 6.757 | 0 | 0 | 0 |
| OCBBF10000420 | 0 | 0 | 100 | 0 | 0 | 0 | 0 | 0 | 0 | 0 | 0 | 0 | 0 |
| OCBBF10000670 | 0 | 0 | 100 | 0 | 0 | 0 | 0 | 0 | 0 | 0 | 0 | 0 | 0 |
| OCBBF10000860 | 0 | 0 | 100 | 0 | 0 | 0 | 0 | 0 | 0 | 0 | 0 | 0 | 0 |
| OCBBF10000910 | 0 | 0 | 100 | 0 | 0 | 0 | 0 | 0 | 0 | 0 | 0 | 0 | 0 |
| OCBBF10001040 | 0 | 0 | 100 | 0 | 0 | 0 | 0 | 0 | 0 | 0 | 0 | 0 | 0 |
| OCBBF10001180 | 0 | 0 | 100 | 0 | 0 | 0 | 0 | 0 | 0 | 0 | 0 | 0 | 0 |
| OCBBF10001190 | 0 | 0 | 100 | 0 | 0 | 0 | 0 | 0 | 0 | 0 | 0 | 0 | 0 |
| OCBBF10001220 | 0 | 0 | 100 | 0 | 0 | 0 | 0 | 0 | 0 | 0 | 0 | 0 | 0 |
| OCBBF20002770 | 0 | 0 | 60.117 | 0 | 0 | 0 | 0 | 0 | 0 | 0 | 0 | 0 | 0 |
| OCBBF20002870 | 0 | 0 | 50.533 | 0 | 0 | 0 | 0 | 0 | 0 | 0 | 0 | 0 | 0 |
| OCBBF20007190 | 0 | 0 | 100 | 0 | 0 | 0 | 0 | 0 | 0 | 0 | 0 | 0 | 0 |
| OCBBF20008240 | 0 | 0 | 100 | 0 | 0 | 0 | 0 | 0 | 0 | 0 | 0 | 0 | 0 |
| OCBBF20009980 | 0 | 0 | 100 | 0 | 0 | 0 | 0 | 0 | 0 | 0 | 0 | 0 | 0 |
| OCBBF20010750 | 0 | 0 | 100 | 0 | 0 | 0 | 0 | 0 | 0 | 0 | 0 | 0 | 0 |
| OCBBF20011010 | 0 | 0 | 100 | 0 | 0 | 0 | 0 | 0 | 0 | 0 | 0 | 0 | 0 |
| OCBBF20011400 | 0 | 0 | 100 | 0 | 0 | 0 | 0 | 0 | 0 | 0 | 0 | 0 | 0 |
| OCBBF20011760 | 0 | 0 | 100 | 0 | 0 | 0 | 0 | 0 | 0 | 0 | 0 | 0 | 0 |
| OCBBF20014080 | 0 | 0 | 60.331 | 0 | 0 | 0 | 0 | 0 | 0 | 39.669 | 0 | 0 | 0 |
| OCBBF20014940 | 0 | 0 | 50.836 | 0 | 0 | 0 | 0 | 0 | 0 | 0 | 0 | 0 | 0 |
| OCBBF20015270 | 0 | 0 | 100 | 0 | 0 | 0 | 0 | 0 | 0 | 0 | 0 | 0 | 0 |
| OCBBF20015280 | 0 | 0 | 71.737 | 0 | 0 | 0 | 0 | 0 | 0 | 0 | 0 | 0 | 0 |
| OCBBF20015860 | 0 | 0 | 24.693 | 0 | 0 | 0 | 0 | 0 | 0 | 0 | 0 | 0 | 0 |
| OCBBF20017060 | 0 | 0 | 64.872 | 0 | 0 | 0 | 0 | 0 | 0 | 0 | 0 | 0 | 0 |
| PLACE60043960 | 0 | 0 | 5.034 | 0 | 0 | 0 | 0 | 0 | 0 | 0 | 0 | 0 | 0 |
| SMINT20002770 | 0 | 0 | 3.07 | 0 | 0 | 0 | 0 | 0 | 0 | 0 | 0 | 0 | 0 |
| TESTI20001790 | 0 | 0 | 51.667 | 0 | 0 | 0 | 0 | 0 | 0 | 0 | 0 | 0 | 0 |
| TESTI20007840 | 0 | 0 | 9.849 | 0 | 0 | 0 | 2.684 | 0 | 0 | 0 | 0 | 0 | 0 |
| TESTI20009700 | 0 | 0 | 15.137 | 0 | 15.173 | 0 | 0 | 0 | 14.875 | 0 | 15.629 | 0 | 0 |
| TESTI20027070 | 0 | 0 | 15.298 | 0 | 7.667 | 4.857 | 16.674 | 9.736 | 15.033 | 5.029 | 7.897 | 0 | 0 |
| TESTI20053960 | 0 | 0 | 16.779 | 0 | 0 | 0 | 9.144 | 5.339 | 8.244 | 5.516 | 0 | 0 | 0 |
| TRACH20000790 | 0 | 0 | 4.688 | 0 | 0 | 5.954 | 5.11 | 0 | 4.607 | 0 | 0 | 0 | 0 |
| 3NB6920010220 | 0 | 2.443 | 3.509 | 2.31 | 3.517 | 0 | 0 | 0 | 0 | 2.307 | 3.623 | 0 | 0 |
| BRACE10001870 | 0 | 29.559 | 21.228 | 13.977 | 21.278 | 0 | 0 | 0 | 0 | 13.958 | 0 | 0 | 0 |
| BRAWH20014840 | 0 | 5.654 | 8.12 | 5.347 | 8.139 | 0 | 8.851 | 0 | 7.98 | 5.339 | 0 | 0 | 0 |
| BRAWH20040950 | 0 | 9.758 | 14.015 | 9.228 | 0 | 8.899 | 15.276 | 0 | 0 | 27.646 | 0 | 0 | 0 |

TABLE 33

| | | | | | | | | | | | | | |
|---|---|---|---|---|---|---|---|---|---|---|---|---|---|
| FEBRA20011970 | 0 | 41.046 | 58.954 | 0 | 0 | 0 | 0 | 0 | 0 | 0 | 0 | 0 | 0 |
| KIDNE20062480 | 0 | 1.07 | 1.537 | 1.012 | 0 | 1.952 | 0 | 0.978 | 1.51 | 0 | 0 | 3.066 | 0 |
| NT2RI20029580 | 0 | 18.599 | 13.356 | 0 | 0 | 2.827 | 0 | 0 | 4.375 | 2.927 | 4.597 | 4.442 | 0 |
| NT2RI20035560 | 0 | 4.061 | 5.832 | 0 | 5.846 | 3.704 | 0 | 0 | 0 | 0 | 0 | 0 | 0 |
| NT2RI20043980 | 0 | 17.204 | 24.709 | 16.27 | 0 | 15.69 | 0 | 0 | 0 | 0 | 0 | 0 | 0 |
| NT2RP70000760 | 0 | 6.554 | 2.353 | 0 | 2.359 | 0 | 2.565 | 0 | 6.938 | 0 | 2.43 | 0 | 0 |
| NT2RP70042040 | 0 | 6.959 | 9.994 | 0 | 0 | 0 | 0 | 6.361 | 0 | 19.715 | 10.319 | 0 | 0 |
| NT2RP70069860 | 0 | 7.736 | 11.11 | 0 | 0 | 0 | 0 | 0 | 0 | 14.611 | 0 | 0 | 0 |
| NT2RP70088550 | 0 | 22.251 | 15.98 | 0 | 0 | 30.441 | 0 | 0 | 15.704 | 0 | 0 | 0 | 0 |
| OCBBF20001260 | 0 | 25.989 | 37.328 | 0 | 0 | 0 | 0 | 0 | 36.683 | 0 | 0 | 0 | 0 |
| TESTI10000230 | 0 | 11.473 | 8.239 | 0 | 0 | 15.695 | 0 | 2.622 | 0 | 2.709 | 0 | 4.11 | 0 |
| 3NB6920017190 | 3.131 | 0 | 6.11 | 4.023 | 0 | 0 | 0 | 0 | 6.005 | 4.018 | 0 | 12.192 | 0 |
| ADRGL10000020 | 20.819 | 0 | 50.778 | 0 | 0 | 0 | 0 | 0 | 0 | 0 | 0 | 0 | 0 |
| BRACE10001660 | 17.458 | 0 | 34.065 | 11.215 | 0 | 0 | 0 | 0 | 16.738 | 0 | 0 | 0 | 0 |
| BRAWH10001620 | 12.03 | 0 | 46.948 | 0 | 0 | 0 | 25.587 | 0 | 0 | 15.435 | 0 | 0 | 0 |
| CTONG20028030 | 13.637 | 0 | 13.304 | 0 | 0 | 0 | 0 | 8.467 | 0 | 0 | 0 | 0 | 0 |
| KIDNE20004030 | 2.947 | 0 | 5.75 | 0 | 0 | 0 | 0 | 3.659 | 5.65 | 0 | 0 | 0 | 0 |
| KIDNE20060300 | 1.54 | 0 | 3.005 | 0 | 0 | 0 | 0 | 1.913 | 5.907 | 3.952 | 0 | 0 | 0 |
| NB9N420000420 | 1.74 | 0 | 3.395 | 0 | 0 | 0 | 0 | 0 | 0 | 0 | 3.505 | 0 | 0 |
| NT2NE20000560 | 9.347 | 0 | 4.56 | 0 | 0 | 5.79 | 0 | 0 | 4.481 | 14.99 | 4.708 | 0 | 12.604 |
| NT2NE20004700 | 17.081 | 0 | 33.329 | 0 | 0 | 0 | 0 | 0 | 0 | 0 | 0 | 0 | 0 |
| NT2NE20007630 | 7.97 | 0 | 15.551 | 0 | 0 | 0 | 0 | 0 | 15.282 | 10.225 | 0 | 0 | 0 |
| NT2RI20004120 | 11.856 | 0 | 23.135 | 0 | 0 | 29.381 | 0 | 0 | 0 | 0 | 0 | 0 | 0 |
| NT2RI20013420 | 5.338 | 0 | 4.166 | 1.372 | 0 | 0 | 0 | 0 | 0 | 0 | 0 | 0 | 0 |
| NT2RI20033380 | 5.159 | 0 | 10.066 | 0 | 0 | 0 | 0 | 0 | 0 | 0 | 0 | 0 | 0 |
| NT2RI20036950 | 9.835 | 0 | 4.798 | 0 | 0 | 6.093 | 10.459 | 6.107 | 0 | 0 | 0 | 0 | 0 |
| NT2RI20053350 | 2.442 | 0 | 2.382 | 1.569 | 0 | 0 | 0 | 0 | 0 | 4.699 | 0 | 0 | 0 |
| NT2RI20053680 | 1.805 | 0 | 3.521 | 0 | 0 | 0 | 0 | 0 | 3.461 | 4.631 | 0 | 0 | 0 |
| NT2RI20078840 | 5.854 | 0 | 11.422 | 0 | 0 | 0 | 0 | 7.269 | 22.449 | 0 | 0 | 11.395 | 0 |
| NT2RI20083360 | 2.754 | 0 | 8.061 | 1.769 | 0 | 0 | 0 | 0 | 0 | 1.767 | 2.774 | 0 | 0 |
| NT2RI20090650 | 4.665 | 0 | 6.069 | 3.996 | 6.083 | 1.927 | 6.615 | 0 | 2.982 | 0 | 3.133 | 0 | 0 |
| NT2RP60001090 | 3.638 | 0 | 7.098 | 0 | 0 | 0 | 0 | 0 | 0 | 0 | 0 | 0 | 0 |
| NT2RP70004770 | 11.575 | 0 | 11.293 | 0 | 0 | 0 | 0 | 7.187 | 0 | 0 | 0 | 0 | 0 |
| NT2RP70023790 | 7.18 | 0 | 4.67 | 0 | 0 | 2.966 | 0 | 0 | 0 | 1.535 | 2.411 | 0 | 0 |
| NT2RP70055200 | 20.056 | 0 | 19.568 | 0 | 0 | 0 | 0 | 0 | 0 | 0 | 0 | 0 | 0 |
| NT2RP70085570 | 9.507 | 0 | 18.55 | 0 | 0 | 0 | 0 | 0 | 0 | 6.099 | 0 | 0 | 0 |

TABLE 34

| | | | | | | | | | | | | | |
|---|---|---|---|---|---|---|---|---|---|---|---|---|---|
| NTONG10000980 | 3.528 | 0 | 6.884 | 2.266 | 0 | 0 | 3.752 | 0 | 0 | 4.527 | 3.554 | 0 | 0 |
| NTONG20016120 | 11.301 | 0 | 22.052 | 0 | 0 | 0 | 0 | 0 | 0 | 0 | 0 | 0 | 0 |
| OCBBF20011240 | 12.096 | 0 | 11.802 | 0 | 0 | 0 | 0 | 0 | 0 | 0 | 0 | 0 | 0 |
| OCBBF20012100 | 42.373 | 0 | 41.34 | 0 | 0 | 0 | 0 | 0 | 0 | 0 | 0 | 0 | 0 |
| OCBBF20013070 | 4.012 | 0 | 7.829 | 0 | 0 | 9.943 | 0 | 4.983 | 23.082 | 10.296 | 16.167 | 0 | 0 |
| OCBBF20014020 | 33.884 | 0 | 66.116 | 0 | 0 | 0 | 0 | 0 | 0 | 0 | 0 | 0 | 0 |
| PEBLM20003950 | 9.132 | 0 | 4.455 | 0 | 0 | 0 | 4.855 | 0 | 0 | 0 | 0 | 0 | 0 |
| PLACE50001130 | 12.74 | 0 | 24.859 | 0 | 0 | 0 | 0 | 0 | 0 | 0 | 0 | 0 | 0 |
| PLACE60021510 | 27.281 | 0 | 10.646 | 0 | 0 | 0 | 0 | 13.551 | 0 | 0 | 0 | 0 | 0 |
| PUAEN10000570 | 3.444 | 0 | 13.439 | 0 | 0 | 0 | 7.324 | 4.276 | 0 | 0 | 0 | 0 | 0 |
| SKNMC20000970 | 2.423 | 0 | 1.182 | 1.557 | 0 | 0 | 2.577 | 0 | 0 | 0.777 | 0 | 0 | 0 |
| TESTI20040310 | 1.367 | 0 | 2.668 | 0 | 0 | 0 | 0 | 0 | 0 | 0 | 2.754 | 0 | 0 |
| TRACH20004610 | 6.994 | 0 | 13.647 | 0 | 0 | 0 | 0 | 0 | 13.411 | 0 | 0 | 0 | 0 |
| 3NB6920005450 | 3.772 | 5.125 | 0 | 4.847 | 0 | 0 | 0 | 0 | 0 | 0 | 0 | 0 | 0 |
| BRACE10000420 | 3.858 | 2.62 | 0 | 2.478 | 3.772 | 2.39 | 4.102 | 2.395 | 7.397 | 7.424 | 0 | 0 | 0 |
| BRACE20076410 | 27.681 | 18.803 | 0 | 8.891 | 13.535 | 17.149 | 0 | 0 | 0 | 0 | 13.942 | 0 | 0 |
| BRACE20078820 | 7.698 | 10.458 | 0 | 39.561 | 0 | 9.538 | 32.745 | 0 | 0 | 0 | 0 | 0 | 0 |
| BRAWH20006860 | 6.302 | 25.683 | 0 | 0 | 0 | 0 | 26.805 | 0 | 12.084 | 0 | 0 | 12.267 | 0 |
| BRAWH20089030 | 9.281 | 12.609 | 0 | 0 | 0 | 11.5 | 19.741 | 23.052 | 0 | 23.817 | 0 | 0 | 0 |
| FCBBF10006750 | 20.441 | 27.77 | 0 | 0 | 0 | 25.327 | 0 | 0 | 0 | 0 | 0 | 0 | 0 |
| FCBBF10006860 | 42.399 | 57.601 | 0 | 0 | 0 | 0 | 0 | 0 | 0 | 0 | 0 | 0 | 0 |
| FCBBF20015380 | 7.341 | 3.324 | 0 | 6.288 | 0 | 9.096 | 0 | 6.078 | 0 | 15.698 | 9.86 | 4.764 | 0 |
| FCBBF50002610 | 1.945 | 5.285 | 0 | 0 | 0 | 0 | 0 | 0 | 0 | 0 | 0 | 0 | 0 |
| FEBRA20004520 | 45.718 | 20.704 | 0 | 0 | 0 | 0 | 0 | 0 | 0 | 0 | 0 | 0 | 0 |
| FEBRA20005360 | 3.428 | 9.315 | 0 | 17.618 | 0 | 4.247 | 0 | 4.257 | 0 | 4.398 | 0 | 0 | 0 |
| FEBRA20009010 | 23.228 | 31.556 | 0 | 0 | 0 | 0 | 0 | 0 | 0 | 0 | 0 | 45.216 | 0 |
| FEBRA20014920 | 42.399 | 57.601 | 0 | 0 | 0 | 0 | 0 | 0 | 0 | 0 | 0 | 0 | 0 |
| FEBRA20015840 | 13.059 | 17.741 | 0 | 0 | 0 | 16.18 | 0 | 0 | 0 | 0 | 0 | 0 | 0 |
| FEBRA20021910 | 10.174 | 13.822 | 0 | 0 | 0 | 12.605 | 0 | 0 | 0 | 0 | 0 | 0 | 0 |
| FEBRA20021940 | 0.894 | 2.429 | 0 | 2.297 | 3.497 | 1.108 | 0 | 1.11 | 0 | 0 | 0 | 1.74 | 0 |
| FEBRA20043250 | 6.453 | 8.767 | 0 | 0 | 0 | 0 | 0 | 0 | 0 | 0 | 0 | 0 | 0 |
| FEBRA20057780 | 12.772 | 34.702 | 0 | 0 | 0 | 0 | 0 | 0 | 0 | 0 | 0 | 0 | 0 |
| FEBRA20057880 | 22.294 | 30.288 | 0 | 0 | 0 | 0 | 47.417 | 0 | 0 | 0 | 0 | 0 | 0 |
| FEBRA20066270 | 59.549 | 40.451 | 0 | 0 | 0 | 0 | 0 | 0 | 0 | 0 | 0 | 0 | 0 |
| FEBRA20074580 | 17.81 | 24.196 | 0 | 0 | 0 | 0 | 0 | 0 | 0 | 0 | 0 | 0 | 0 |
| HHDPC20000550 | 15.129 | 10.276 | 0 | 0 | 0 | 0 | 0 | 0 | 14.505 | 9.705 | 0 | 0 | 0 |

TABLE 35

| | | | | | | | | | | | | | |
|---|---|---|---|---|---|---|---|---|---|---|---|---|---|
| HSYRA20015740 | 4.24 | 11.522 | 0 | 0 | 0 | 5.254 | 0 | 0 | 8.131 | 5.44 | 8.543 | 0 | 0 |
| HSYRA20016210 | 1.233 | 1.005 | 0 | 0 | 3.859 | 5.5 | 0 | 8.575 | 3.31 | 0.949 | 7.453 | 5.281 | 1.33 |
| IMR3210002420 | 3.621 | 4.919 | 0 | 0 | 0 | 0 | 0 | 0 | 0 | 0 | 7.294 | 0 | 0 |
| IMR3220016000 | 0.382 | 0.519 | 0 | 0 | 0 | 0 | 0 | 0 | 0 | 0.49 | 0 | 0.744 | 0 |
| KIDNE20060140 | 7.34 | 9.972 | 0 | 0 | 0 | 0 | 0 | 0 | 0 | 0 | 0 | 0 | 0 |
| MAMGL10000320 | 0.301 | 0.409 | 0 | 0 | 0.59 | 0.747 | 0 | 0.374 | 0.578 | 0.387 | 0 | 0.587 | 1.626 |
| NT2NE20008090 | 8.923 | 12.122 | 0 | 0 | 0 | 0 | 0 | 0 | 0 | 0 | 17.976 | 0 | 0 |
| NT2NE20014350 | 10.711 | 9.701 | 0 | 4.587 | 13.966 | 4.424 | 0 | 0 | 0 | 0 | 0 | 0 | 0 |
| NT2RI20000640 | 1.604 | 1.09 | 0 | 0 | 0 | 0 | 1.706 | 0 | 0 | 1.029 | 0 | 0 | 0 |
| NT2RI20002940 | 9.692 | 26.333 | 0 | 0 | 0 | 0 | 0 | 0 | 0 | 12.434 | 0 | 0 | 0 |
| NT2RI20015400 | 0.148 | 0.402 | 0 | 21.074 | 0 | 0.183 | 0 | 0.367 | 0 | 0 | 0 | 0 | 0 |
| NT2RI20033830 | 5.44 | 14.78 | 0 | 20.966 | 0 | 6.74 | 11.569 | 6.755 | 0 | 0 | 0 | 0 | 0 |
| NT2RI20037510 | 1.298 | 1.764 | 0 | 0 | 0 | 0 | 2.761 | 3.224 | 0 | 0 | 2.616 | 0 | 0 |
| NT2RI20057230 | 2.535 | 3.444 | 0 | 4.885 | 0 | 3.141 | 5.391 | 4.722 | 0 | 3.252 | 2.553 | 4.934 | 0 |
| NT2RI20087910 | 2.993 | 2.033 | 0 | 0 | 2.927 | 3.709 | 3.183 | 0 | 2.87 | 3.841 | 0 | 2.914 | 0 |
| NT2RI20089420 | 14.023 | 12.701 | 0 | 0 | 0 | 5.792 | 0 | 0 | 0 | 0 | 0 | 0 | 0 |
| NT2RP70043730 | 3.934 | 5.344 | 0 | 0 | 0 | 0 | 0 | 0 | 5.047 | 7.925 | 0 | 0 | 0 |
| NT2RP70047900 | 4.861 | 6.604 | 0 | 6.246 | 0 | 0 | 6.037 | 0 | 12.474 | 0 | 0 | 26.221 | 0 |
| PLACE60043120 | 2.116 | 2.874 | 0 | 5.436 | 0 | 5.243 | 4.5 | 0 | 0 | 2.714 | 0 | 4.118 | 0 |
| PROST20033020 | 4.928 | 6.695 | 0 | 6.331 | 0 | 6.106 | 10.481 | 12.239 | 0 | 6.322 | 0 | 0 | 26.581 |
| SYNOV10001280 | 3.506 | 4.763 | 0 | 0 | 0 | 0 | 0 | 0 | 0 | 0 | 7.063 | 0 | 0 |
| TESTI20021490 | 14.02 | 4.762 | 0 | 0 | 0 | 0 | 0 | 0 | 0 | 0 | 0 | 0 | 0 |
| THYMU20002360 | 10.405 | 14.136 | 0 | 0 | 20.352 | 0 | 0 | 0 | 0 | 13.35 | 20.963 | 0 | 0 |
| TRACH20012890 | 4.522 | 1.536 | 0 | 0 | 0 | 1.401 | 0 | 1.404 | 0 | 2.901 | 2.278 | 2.201 | 0 |
| 3NB6910001290 | 2.384 | 3.239 | 4.653 | 0 | 0 | 0 | 10.143 | 0 | 0 | 3.059 | 0 | 0 | 0 |
| BNGH420004740 | 4.385 | 9.928 | 2.852 | 1.878 | 0 | 0 | 0 | 0 | 0 | 1.875 | 0 | 0 | 0 |
| BRACE20034490 | 9.437 | 32.053 | 27.622 | 6.063 | 9.229 | 0 | 0 | 5.86 | 0 | 0 | 0 | 0 | 0 |
| BRAWH20005220 | 3.286 | 4.464 | 6.412 | 0 | 6.427 | 4.071 | 6.989 | 4.081 | 0 | 4.216 | 6.62 | 0 | 0 |
| FEBRA20003770 | 17.948 | 24.384 | 35.022 | 0 | 0 | 0 | 0 | 0 | 0 | 0 | 0 | 0 | 0 |
| FEBRA20007570 | 26.742 | 10.38 | 29.818 | 0 | 0 | 3.156 | 0 | 0 | 2.442 | 3.268 | 0 | 7.437 | 0 |
| FEBRA20008740 | 19.259 | 26.164 | 26.305 | 2.474 | 0 | 2.386 | 0 | 0 | 0 | 4.942 | 0 | 0 | 0 |
| FEBRA20012450 | 13.91 | 9.449 | 27.141 | 0 | 0 | 0 | 0 | 0 | 13.336 | 8.923 | 0 | 0 | 0 |
| FEBRA20012450 | 13.91 | 9.449 | 27.141 | 0 | 0 | 0 | 0 | 0 | 13.336 | 8.923 | 0 | 0 | 0 |
| FEBRA20017150 | 31.686 | 7.174 | 30.913 | 0 | 0 | 0 | 0 | 0 | 0 | 0 | 0 | 0 | 0 |
| FEBRA20025250 | 8.913 | 24.219 | 17.392 | 0 | 0 | 0 | 0 | 0 | 0 | 11.436 | 0 | 17.352 | 0 |
| FEBRA20044120 | 19.397 | 10.541 | 15.139 | 0 | 0 | 0 | 0 | 0 | 0 | 0 | 0 | 0 | 0 |

TABLE 36

| Clone ID | | | | | | | | | | | | | |
|---|---|---|---|---|---|---|---|---|---|---|---|---|---|
| FEBRA20076220 | 7.094 | 1.606 | 4.614 | 1.519 | 0 | 1.465 | 0 | 0 | 0 | 1.517 | 2.382 | 0 | 0 |
| HSYRA20002480 | 4.385 | 9.928 | 2.852 | 1.878 | 0 | 0 | 0 | 0 | 0 | 1.875 | 0 | 0 | 0 |
| IMR3220014350 | 4.337 | 2.946 | 4.232 | 5.572 | 0 | 0 | 4.612 | 0 | 0 | 0 | 0 | 0 | 0 |
| MESAN20001490 | 4.119 | 5.596 | 8.037 | 0 | 0 | 0 | 0 | 0 | 15.797 | 0 | 8.298 | 0 | 22.218 |
| NHNPC20002060 | 0.878 | 1.192 | 1.713 | 0 | 0 | 0 | 0 | 1.09 | 1.683 | 0 | 0 | 0 | 0 |
| NT2NE10000180 | 4.752 | 6.455 | 9.271 | 0 | 0 | 17.662 | 0 | 5.901 | 0 | 12.193 | 0 | 0 | 0 |
| NT2NE20003920 | 24.178 | 24.087 | 9.435 | 4.142 | 0 | 1.997 | 0 | 2.002 | 0 | 8.272 | 3.247 | 9.413 | 0 |
| NT2RI20006690 | 14.42 | 6.53 | 18.758 | 0 | 0 | 0 | 10.223 | 0 | 0 | 0 | 0 | 0 | 0 |
| NT2RI20013850 | 7.701 | 1.495 | 2.147 | 1.413 | 2.152 | 0 | 2.34 | 0 | 0 | 0 | 2.216 | 0 | 0 |
| NT2RI20014500 | 8.005 | 14.501 | 5.207 | 3.428 | 0 | 16.531 | 11.351 | 6.628 | 5.117 | 20.542 | 0 | 0 | 0 |
| NT2RI20025540 | 5.906 | 8.024 | 28.812 | 0 | 0 | 3.659 | 0 | 0 | 0 | 0 | 5.95 | 0 | 0 |
| NT2RI20033010 | 13.235 | 17.981 | 51.651 | 0 | 0 | 0 | 0 | 0 | 0 | 0 | 0 | 0 | 0 |
| NT2RI20075720 | 9.059 | 3.077 | 22.096 | 0 | 0 | 0 | 4.817 | 2.812 | 0 | 0 | 0 | 4.409 | 0 |
| NT2RP60000350 | 1.407 | 2.868 | 9.611 | 0 | 0 | 0.872 | 0 | 0 | 0 | 2.708 | 0 | 0 | 0 |
| NT2RP60001230 | 26.971 | 10.992 | 5.263 | 0 | 0 | 3.342 | 5.736 | 0 | 0 | 3.46 | 0 | 0 | 0 |
| NT2RP70028750 | 4.921 | 7.799 | 14.402 | 3.161 | 3.208 | 1.016 | 8.721 | 0 | 0 | 5.261 | 4.957 | 3.193 | 4.424 |
| NT2RP70029060 | 3.211 | 2.181 | 6.266 | 2.063 | 0 | 9.947 | 0 | 1.994 | 0 | 4.12 | 6.47 | 3.126 | 0 |
| NT2RP70032030 | 18.539 | 6.297 | 18.088 | 0 | 0 | 0 | 14.787 | 5.756 | 0 | 0 | 0 | 4.511 | 0 |
| NTONG20003340 | 6.944 | 9.434 | 13.549 | 8.922 | 13.581 | 0 | 0 | 0 | 0 | 0 | 0 | 0 | 0 |
| OCBBF20000130 | 3.85 | 15.691 | 22.537 | 0 | 0 | 0 | 0 | 0 | 0 | 0 | 0 | 0 | 0 |
| OCBBF20002310 | 8.981 | 6.1 | 26.286 | 0 | 0 | 5.564 | 9.55 | 11.153 | 0 | 11.522 | 0 | 0 | 0 |
| OCBBF20009040 | 29.316 | 13.276 | 19.068 | 0 | 0 | 0 | 0 | 0 | 0 | 0 | 0 | 0 | 0 |
| SKNMC20000650 | 7.095 | 7.229 | 10.382 | 0 | 0 | 0 | 0 | 0 | 0 | 2.276 | 3.573 | 0 | 9.567 |
| SMINT20003960 | 3.445 | 1.17 | 3.361 | 0 | 0 | 0 | 0 | 0 | 0 | 0 | 0 | 0 | 0 |
| TESTI20026320 | 6.566 | 8.92 | 12.811 | 0 | 0 | 0 | 0 | 0 | 0 | 0 | 13.228 | 0 | 0 |
| TESTI20080200 | 4.326 | 1.959 | 7.033 | 0.926 | 0 | 0 | 9.2 | 0.895 | 0 | 1.85 | 0 | 0 | 3.889 |

TABLE 37

| Clone ID | FEHRT | HEART |
|---|---|---|
| KIDNE20062480 | 36.242 | 0 |
| NT2RI20033040 | 40.301 | 0 |
| NT2RP60000350 | 32.381 | 0 |
| BGGI120010970 | 0 | 9.222 |
| BRACE10000420 | 0 | 23.223 |
| BRACE10001150 | 0 | 1.324 |
| BRACE20003320 | 0 | 31.422 |
| BRACE20077980 | 0 | 15.184 |
| BRAWH10000370 | 0 | 65.363 |
| BRAWH20000340 | 0 | 22.282 |
| BRAWH20011660 | 0 | 6.271 |
| BRAWH20014840 | 0 | 16.703 |
| FEBRA20008740 | 0 | 7.73 |
| FEBRA20072800 | 0 | 74.711 |
| HEART20000350 | 0 | 100 |
| HEART20000990 | 0 | 100 |
| HEART20003090 | 0 | 100 |
| HEART20004110 | 0 | 100 |
| HEART20004480 | 0 | 100 |
| HEART20004920 | 0 | 100 |
| HEART20005060 | 0 | 58.813 |
| HEART20005200 | 0 | 100 |
| HEART20005680 | 0 | 100 |
| HHDPC20001150 | 0 | 23.261 |
| HLUNG20005010 | 0 | 5.241 |
| HSYRA20014200 | 0 | 12.434 |
| IMR3220013170 | 0 | 9.002 |
| KIDNE20004970 | 0 | 26.564 |
| NT2RI20000640 | 0 | 3.219 |
| NT2RI20006710 | 0 | 5.218 |
| NT2RI20015400 | 0 | 0.593 |
| NT2RI20026540 | 0 | 8.062 |
| NT2RI20037510 | 0 | 5.211 |
| NT2RI20057230 | 0 | 20.346 |
| NT2RI20064120 | 0 | 17.978 |
| NT2RI20071330 | 0 | 14.303 |
| NT2RI20071480 | 0 | 24.983 |
| NT2RI20077540 | 0 | 60.787 |
| NT2RI20084810 | 0 | 13.301 |
| NT2RI20087910 | 0 | 6.007 |
| NT2RP70000760 | 0 | 9.681 |
| NT2RP70024500 | 0 | 41.168 |
| NT2RP70029060 | 0 | 6.444 |
| NTONG10001820 | 0 | 13.117 |
| PLACE60012810 | 0 | 32.247 |
| PLACE60043120 | 0 | 8.491 |
| PROST20000530 | 0 | 23.813 |
| SKMUS10000640 | 0 | 27.233 |
| SKMUS20004580 | 0 | 8.731 |
| SKMUS20015010 | 0 | 18.378 |
| SMINT20002770 | 0 | 6.315 |
| TESTI20033250 | 0 | 58.713 |
| TESTI20074640 | 0 | 25.552 |
| UMVEN20001330 | 0 | 6.282 |

TABLE 38

| Clone ID | FEKID | KIDNE |
|---|---|---|
| 3NB6920003300 | 0 | 2.071 |
| 3NB6920009120 | 0 | 2.884 |
| BGGI120010970 | 0 | 4.336 |
| BRACE20004210 | 0 | 3.583 |
| BRACE20005250 | 0 | 6.242 |
| BRACE20011170 | 0 | 3.303 |
| BRACE20020910 | 0 | 19.111 |
| BRACE20026850 | 0 | 34.356 |
| BRACE20080970 | 0 | 20.33 |
| BRAWH20000340 | 0 | 10.476 |
| BRAWH20006970 | 0 | 3.96 |
| BRAWH20011660 | 0 | 5.897 |
| FCBBF20001950 | 0 | 65.363 |
| FEBRA20021940 | 0 | 1.687 |
| FEBRA20043250 | 0 | 12.177 |
| HLUNG10000640 | 0 | 23.921 |
| IMR3220007420 | 0 | 2.375 |
| IMR3220014350 | 0 | 4.092 |
| KIDNE10000280 | 0 | 100 |
| KIDNE10000500 | 0 | 15.868 |
| KIDNE10001040 | 0 | 100 |
| KIDNE10001430 | 0 | 100 |
| KIDNE10001450 | 0 | 19.052 |
| KIDNE10001520 | 0 | 100 |
| KIDNE20000410 | 0 | 100 |

TABLE 38-continued

| Clone ID | FEKID | KIDNE |
|---|---|---|
| KIDNE20000510 | 0 | 100 |
| KIDNE20000700 | 0 | 100 |
| KIDNE20000850 | 0 | 4.788 |
| KIDNE20001670 | 0 | 100 |
| KIDNE20001920 | 0 | 100 |
| KIDNE20002440 | 0 | 37.565 |
| KIDNE20002450 | 0 | 100 |
| KIDNE20002660 | 0 | 7 |
| KIDNE20003150 | 0 | 100 |
| KIDNE20003300 | 0 | 20.536 |
| KIDNE20003490 | 0 | 64.026 |
| KIDNE20003750 | 0 | 100 |
| KIDNE20004030 | 0 | 5.561 |
| KIDNE20004220 | 0 | 35.77 |
| KIDNE20004970 | 0 | 12.49 |
| KIDNE20005130 | 0 | 100 |
| KIDNE20005170 | 0 | 81.524 |
| KIDNE20005190 | 0 | 100 |
| KIDNE20005740 | 0 | 2.3 |
| KIDNE20031850 | 0 | 16.193 |
| KIDNE20033050 | 0 | 3.381 |
| KIDNE20033350 | 0 | 100 |
| KIDNE20033570 | 0 | 53.825 |
| KIDNE20033730 | 0 | 100 |
| KIDNE20033770 | 0 | 100 |
| KIDNE20037520 | 0 | 100 |
| KIDNE20039410 | 0 | 100 |
| KIDNE20039940 | 0 | 43.968 |
| KIDNE20040340 | 0 | 100 |
| KIDNE20040540 | 0 | 49.114 |
| KIDNE20040840 | 0 | 100 |
| KIDNE20042620 | 0 | 100 |
| KIDNE20042940 | 0 | 100 |
| KIDNE20042950 | 0 | 100 |
| KIDNE20043440 | 0 | 100 |
| KIDNE20045200 | 0 | 100 |
| KIDNE20045340 | 0 | 17.53 |
| KIDNE20045790 | 0 | 100 |
| KIDNE20046810 | 0 | 100 |
| KIDNE20048280 | 0 | 100 |
| KIDNE20048640 | 0 | 34.264 |
| KIDNE20048790 | 0 | 100 |
| KIDNE20049810 | 0 | 100 |
| KIDNE20050420 | 0 | 35.626 |
| KIDNE20052960 | 0 | 100 |
| KIDNE20053360 | 0 | 58.142 |
| KIDNE20054000 | 0 | 49.697 |
| KIDNE20054770 | 0 | 100 |
| KIDNE20056290 | 0 | 100 |
| KIDNE20056760 | 0 | 16.262 |
| KIDNE20059080 | 0 | 100 |
| KIDNE20059370 | 0 | 88.03 |
| KIDNE20060140 | 0 | 13.852 |
| KIDNE20060300 | 0 | 2.906 |
| KIDNE20060530 | 0 | 100 |
| KIDNE20060620 | 0 | 100 |
| KIDNE20061490 | 0 | 100 |
| KIDNE20062480 | 0 | 2.972 |
| KIDNE20062990 | 0 | 31.685 |
| KIDNE20063530 | 0 | 26.747 |
| KIDNE20063760 | 0 | 100 |
| KIDNE20066520 | 0 | 70.185 |
| KIDNE20067600 | 0 | 100 |
| KIDNE20067750 | 0 | 8.487 |
| KIDNE20068800 | 0 | 24.137 |
| KIDNE20070050 | 0 | 66.711 |
| KIDNE20070770 | 0 | 100 |
| KIDNE20071860 | 0 | 39.822 |
| KIDNE20073280 | 0 | 4.537 |
| KIDNE20073520 | 0 | 8.83 |
| KIDNE20073560 | 0 | 100 |
| KIDNE20074220 | 0 | 100 |
| KIDNE20075690 | 0 | 100 |
| KIDNE20078100 | 0 | 100 |
| KIDNE20078110 | 0 | 100 |
| LIVER10000790 | 0 | 15.673 |
| MAMGL10000320 | 0 | 1.138 |

TABLE 38-continued

| Clone ID | FEKID | KIDNE |
|---|---|---|
| NB9N410000470 | 0 | 3.598 |
| NT2NE20053710 | 0 | 1.127 |
| NT2RI20006710 | 0 | 2.454 |
| NT2RI20013420 | 0 | 2.015 |
| NT2RI20016570 | 0 | 23.435 |
| NT2RI20018460 | 0 | 20.967 |
| NT2RI20025540 | 0 | 5.573 |
| NT2RI20040590 | 0 | 13.676 |
| NT2RI20065530 | 0 | 3.41 |
| NT2RI20087490 | 0 | 1.408 |
| NT2RI20087910 | 0 | 2.824 |
| NT2RP60000350 | 0 | 5.311 |
| NT2RP60001230 | 0 | 5.09 |
| NT2RP70043730 | 0 | 14.846 |
| NT2RP70069860 | 0 | 10.745 |
| NT2RP70074220 | 0 | 3.96 |
| OCBBF20014940 | 0 | 49.164 |
| PLACE60014430 | 0 | 4.704 |
| PLACE60020840 | 0 | 2.658 |
| PLACE60043120 | 0 | 3.992 |
| PROST10003430 | 0 | 25.547 |
| SKNMC20000970 | 0 | 1.143 |
| SKNSH20001510 | 0 | 20.208 |
| SMINT10000160 | 0 | 38.817 |
| SMINT20003960 | 0 | 1.625 |
| SPLEN20000470 | 0 | 66.711 |
| SPLEN20001340 | 0 | 88.909 |
| SPLEN20003570 | 0 | 31.635 |
| STOMA10000470 | 0 | 17.849 |
| SYNOV10001280 | 0 | 6.616 |
| TESTI10000700 | 0 | 25.214 |
| TESTI20027070 | 0 | 14.795 |
| TESTI20040310 | 0 | 2.58 |
| TRACH10000300 | 0 | 11.119 |
| TRACH20000790 | 0 | 4.534 |
| TRACH20002500 | 0 | 35.282 |
| TRACH20007800 | 0 | 5.605 |
| KIDNE10000080 | 77.87 | 22.13 |
| KIDNE20044110 | 92.49 | 7.51 |
| NT2RI20033040 | 40.707 | 0 |
| NT2RI20037510 | 60.346 | 0 |
| NT2RP70065270 | 40.543 | 0 |
| TRACH20012890 | 52.552 | 0 |

TABLE 39

| Clone ID | FELNG | HLUNG |
|---|---|---|
| BNGH410001980 | 0 | 16.113 |
| BRACE10000420 | 0 | 7.831 |
| BRACE10001150 | 0 | 1.339 |
| BRACE20014770 | 0 | 28.126 |
| BRACE20018550 | 0 | 25.65 |
| BRAWH20006970 | 0 | 8.521 |
| BRAWH20014610 | 0 | 7.03 |
| FEBRA20008810 | 0 | 19.713 |
| FEBRA20015840 | 0 | 53.019 |
| FEBRA20044120 | 0 | 15.75 |
| HHDPC20001490 | 0 | 25.611 |
| HLUNG10000240 | 0 | 100 |
| HLUNG10000300 | 0 | 100 |
| HLUNG10000370 | 0 | 100 |
| HLUNG10000640 | 0 | 51.466 |
| HLUNG10000760 | 0 | 12.838 |
| HLUNG10000990 | 0 | 100 |
| HLUNG10001050 | 0 | 100 |
| HLUNG10001100 | 0 | 100 |
| HLUNG20000680 | 0 | 72.532 |
| HLUNG20001160 | 0 | 100 |
| HLUNG20001250 | 0 | 100 |
| HLUNG20001420 | 0 | 79.349 |
| HLUNG20001760 | 0 | 100 |
| HLUNG20002550 | 0 | 100 |

TABLE 39-continued

| Clone ID | FELNG | HLUNG |
|---|---|---|
| HLUNG20003140 | 0 | 14.018 |
| HLUNG20004120 | 0 | 42.131 |
| HLUNG20004800 | 0 | 100 |
| HLUNG20005010 | 0 | 5.302 |
| HSYRA20014200 | 0 | 12.578 |
| KIDNE20002660 | 0 | 15.061 |
| KIDNE20033050 | 0 | 3.637 |
| NT2NE20014350 | 0 | 28.99 |
| NT2RI20016570 | 0 | 9.167 |
| NT2RI20026540 | 0 | 8.156 |
| NT2RI20051500 | 0 | 21.652 |
| NT2RI20064120 | 0 | 9.093 |
| NT2RI20083960 | 0 | 17.851 |
| NT2RI20085260 | 0 | 5.474 |
| NT2RI20087490 | 0 | 3.03 |
| NT2RP70009060 | 0 | 18.337 |
| NT2RP70011660 | 0 | 5.822 |
| NT2RP70029060 | 0 | 6.519 |
| NT2RP70055020 | 0 | 10.451 |
| NT2RP70074220 | 0 | 8.521 |
| NT2RP70076100 | 0 | 25.546 |
| NTONG10002460 | 0 | 16.426 |
| NTONG20008000 | 0 | 7.189 |
| PLACE60043120 | 0 | 8.589 |
| SKMUS20016340 | 0 | 15.317 |
| SKNMC20005930 | 0 | 13.727 |
| SMINT20000180 | 0 | 38.989 |
| SMINT20002390 | 0 | 51.283 |
| SMINT20002770 | 0 | 12.776 |
| SMINT20003960 | 0 | 10.489 |
| STOMA10000470 | 0 | 38.402 |
| STOMA20001880 | 0 | 52.43 |
| SYNOV20013740 | 0 | 23.798 |
| TESTI20036250 | 0 | 32.684 |
| TESTI20080200 | 0 | 2.927 |
| TRACH20004610 | 0 | 28.395 |
| BRACE20004210 | 86.645 | 0 |
| IMR3220007420 | 57.437 | 0 |

TABLE 40

Alteration of the expression level of each clone due to TNF-α or LPS stimulation to human monocyte cell line THP-1 and alteration of the expression level of each clone due to co-culture of gastric cancer cell line MKN45 with *Helicobacter pylori*. ctl, TNF and LPS in the column of THP-1, respectively, indicate the relative expression levels in unstimulated THP-1, in the cell stimulated with 10 ng/mL TNF-α for 3 hours, and in the cell stimulated with 1 μg/mL LPS for 3 hours; ctl and *H. pylori* in the column of MKN45 indicate the relative expression levels in MKN45 cultured without *Helicobacter pylori* and in MKN45 co-cultured with *Helicobacter pylori* (at a ratio of MKN45: *Helicobacter pylori* = 1:100 cells (colonies) for 3 hours, respectively [ATAC-PCR]

| | THP-1 | | | MKN45 | |
|---|---|---|---|---|---|
| Clone name | ctl | TNF | LPS | ctl | H. pylori |
| 3NB6920000290 | 2.0 | 1.9 | 0.4 | 0.1 | 0.0 |
| ADRGL10000180 | 2.2 | 5.1 | 2.0 | 3.3 | 5.7 |
| BNGH410001370 | 0.8 | 1.4 | 0.3 | 0.4 | 0.5 |
| BRACE10001590 | 1.5 | 2.3 | 1.6 | 0.4 | 0.8 |
| BRACE10001690 | 2.3 | 3.6 | 2.9 | 2.2 | 1.8 |
| BRACE20010650 | 2.1 | 2.2 | 2.1 | 2.2 | 2.1 |
| BRACE20013400 | 2.6 | 0.8 | 0.2 | 1.5 | 1.1 |
| BRACE20030780 | 0.3 | 1.3 | 0.0 | 2.2 | 1.7 |
| BRACE20034490 | 2.0 | 1.6 | 0.6 | 2.5 | 0.3 |
| BRACE20077640 | 0.4 | 1.0 | 0.1 | 1.7 | 0.3 |
| BRACE20079530 | 0.6 | 0.1 | 0.1 | 0.0 | 0.2 |
| BRACE20083850 | 0.9 | 2.5 | 1.3 | 1.1 | 0.0 |
| BRACE20091880 | 1.5 | 0.5 | 0.1 | 0.5 | 0.0 |
| BRAWH10001620 | 1.8 | 1.0 | 0.3 | 1.1 | 3.1 |
| BRAWH20004430 | 0.2 | 1.4 | 0.2 | 0.5 | 0.5 |
| FCBBF10006180 | 0.1 | 3.6 | 1.3 | 2.1 | 0.7 |
| FEBRA20003780 | 1.5 | 3.0 | 2.8 | 1.7 | 1.3 |
| FEBRA20006800 | 0.7 | 2.4 | 0.9 | 0.0 | 1.6 |
| FEBRA20008810 | 2.3 | 1.4 | 0.9 | 2.3 | 1.3 |
| FEBRA20012940 | 0.4 | 1.0 | 0.2 | 0.7 | 0.6 |
| FEBRA20015840 | 0.1 | 3.3 | 2.6 | 0.1 | 0.0 |
| HCASM10000610 | 1.8 | 2.0 | 2.1 | 2.3 | 2.2 |
| HEART20000350 | 2.0 | 3.3 | 1.8 | 2.3 | 0.5 |
| HEART20004480 | 0.0 | 0.3 | 0.0 | 3.5 | 3.0 |
| HEART20005060 | 1.2 | 0.6 | 0.0 | 4.8 | 4.5 |
| HHDPC20000950 | 0.4 | 0.2 | 0.1 | 1.4 | 0.7 |
| HLUNG10000370 | 0.0 | 1.3 | 0.2 | 2.6 | 0.7 |
| HLUNG20001160 | 0.6 | 3.7 | 1.7 | 0.1 | 0.0 |
| HLUNG20001760 | 1.4 | 0.5 | 0.0 | 0.3 | 0.0 |
| HSYRA20003470 | 1.1 | 1.5 | 0.6 | 1.1 | 0.3 |
| HSYRA20013320 | 0.1 | 1.7 | 0.7 | 1.4 | 0.7 |
| IMR3210001580 | 0.4 | 0.0 | 0.0 | 0.3 | 0.2 |
| IMR3210002660 | 0.8 | 0.4 | 0.2 | 0.5 | 0.4 |
| IMR3220008380 | 0.4 | 0.9 | 0.4 | 1.1 | 0.5 |
| IMR3220008590 | 2.0 | 0.3 | 0.9 | 2.1 | 3.4 |
| KIDNE10001520 | 0.4 | 1.2 | 0.7 | 3.4 | 2.2 |
| KIDNE20000850 | 0.7 | 0.7 | 0.4 | 1.1 | 0.5 |
| KIDNE20003490 | 0.9 | 1.7 | 0.9 | 0.3 | 1.9 |
| KIDNE20005170 | 0.9 | 0.7 | 0.3 | 6.4 | 0.2 |
| KIDNE20033730 | 1.2 | 1.6 | 1.8 | 0.5 | 0.5 |
| KIDNE20040540 | 0.1 | 2.5 | 0.8 | 0.1 | 0.2 |
| KIDNE20050420 | 0.7 | 0.5 | 0.7 | 0.2 | 0.3 |
| KIDNE20061490 | 0.1 | 1.2 | 0.6 | 0.2 | 0.1 |
| KIDNE20062990 | 0.7 | 3.5 | 0.7 | 0.0 | 0.0 |
| LIVER20000330 | 6.0 | 7.4 | 1.1 | 7.3 | 0.6 |
| NT2NE10001630 | 0.1 | 2.6 | 1.4 | 2.5 | 2.7 |
| NT2NE10001850 | 1.1 | 0.3 | 0.1 | 0.4 | 1.1 |
| NT2NE20003920 | 0.6 | 3.3 | 1.6 | 0.5 | 0.2 |
| NT2NE20005500 | 0.6 | 2.6 | 2.2 | 0.1 | 0.2 |
| NT2RI20009740 | 1.2 | 1.9 | 0.9 | 0.1 | 0.0 |
| NT2RI20014500 | 0.2 | 3.5 | 1.7 | 0.0 | 0.0 |
| NT2RI20016570 | 1.2 | 3.6 | 3.1 | 0.0 | 0.1 |
| NT2RI20018660 | 4.3 | 0.5 | 1.3 | 1.9 | 1.8 |
| NT2RI20021520 | 1.1 | 1.5 | 1.1 | 1.1 | 0.5 |
| NT2RI20050870 | 1.0 | 0.6 | 0.3 | 0.7 | 0.8 |
| NT2RI20053350 | 2.2 | 1.0 | 0.9 | 1.5 | 0.6 |
| NT2RI20070480 | 1.5 | 0.3 | 0.0 | 0.0 | 0.0 |
| NT2RI20073030 | 0.4 | 0.6 | 0.4 | 2.0 | 0.8 |
| NT2RI20078270 | 0.2 | 2.6 | 0.5 | 1.4 | 0.3 |
| NT2RI20078790 | 1.7 | 2.4 | 0.7 | 2.2 | 1.6 |
| NT2RI20083360 | 0.1 | 0.4 | 0.2 | 0.1 | 0.3 |
| NT2RP60000080 | 2.2 | 2.5 | 1.5 | 2.0 | 1.1 |
| NT2RP60000390 | 1.6 | 2.3 | 1.2 | 2.3 | 0.4 |
| NT2RP60000590 | 1.6 | 2.0 | 1.3 | 2.5 | 1.3 |
| NTONG10000980 | 0.9 | 0.8 | 0.8 | 1.9 | 0.0 |
| NTONG10002570 | 0.1 | 5.4 | 0.5 | 0.0 | 0.0 |
| PLACE60020160 | 0.8 | 1.2 | 0.6 | 0.0 | 0.0 |
| PLACE60026990 | 0.5 | 0.2 | 0.1 | 3.2 | 2.1 |
| PLACE60047380 | 1.6 | 0.7 | 0.9 | 1.8 | 2.2 |
| PUAEN10003220 | 0.1 | 1.9 | 1.2 | 0.0 | 0.1 |
| SKNMC10000290 | 0.4 | 1.2 | 0.5 | 0.9 | 0.2 |
| SKNMC10001590 | 1.7 | 1.9 | 0.8 | 1.0 | 0.4 |
| SKNMC20000650 | 1.1 | 1.1 | 0.8 | 0.1 | 0.1 |

TABLE 40-continued

Alteration of the expression level of each clone due to TNF-α or LPS stimulation to human monocyte cell line THP-1 and alteration of the expression level of each clone due to co-culture of gastric cancer cell line MKN45 with *Helicobacter pylori*. ctl, TNF and LPS in the column of THP-1, respectively, indicate the relative expression levels in unstimulated THP-1, in the cell stimulated with 10 ng/mL TNF-α for 3 hours, and in the cell stimulated with 1 µg/mL LPS for 3 hours; ctl and *H. pylori* in the column of MKN45 indicate the relative expression levels in MKN45 cultured without *Helicobacter pylori* and in MKN45 co-cultured with *Helicobacter pylori* (at a ratio of MKN45: *Helicobacter pylori* = 1:100 cells (colonies) for 3 hours, respectively [ATAC-PCR]

| Clone name | THP-1 | | | MKN45 | |
|---|---|---|---|---|---|
| | ctl | TNF | LPS | ctl | H. pylori |
| STOMA20002570 | 0.3 | 3.1 | 1.5 | 0.6 | 0.6 |
| STOMA20002890 | 1.8 | 0.8 | 0.4 | 0.1 | 0.2 |
| SYNOV20001770 | 1.7 | 0.5 | 0.5 | 1.7 | 4.2 |
| TESTI10000230 | 2.7 | 4.6 | 3.1 | 2.3 | 1.7 |
| TESTI10000550 | 0.4 | 0.1 | 0.3 | 0.1 | 2.8 |
| TESTI20011340 | 0.3 | 2.3 | 2.2 | 2.2 | 1.9 |
| THYMU10005580 | 1.1 | 2.1 | 1.1 | 1.5 | 1.1 |
| TRACH10000630 | 0.3 | 0.5 | 0.2 | 2.7 | 2.6 |
| TRACH20001960 | 9.4 | 2.7 | 1.3 | 1.0 | 0.4 |
| UMVEN10001220 | 1.9 | 2.8 | 1.0 | 0.8 | 0.2 |
| UMVEN20001330 | 2.2 | 2.2 | 0.0 | 1.0 | 0.1 |
| UTERU20004850 | 1.7 | 6.3 | 2.3 | 0.0 | 0.3 |

Homology Search Result Data

Data obtained by the homology search for full-length nucleotide sequences and deduced amino acid sequences.

In the result of the search shown below, both units, aa and bp, are used as length units for the sequences to be compared.

Each data includes Clone name, Definition in hit data, P value, Length of sequence to be compared, Homology, and Accession number (No.) of hit data. These items are shown in this order and separated by a double-slash mark, //.

3NB6910000180
3NB6910000850
3NB6910001160//STEROIDOGENIC ACUTE REGULATORY PROTEIN PRECURSOR.//9. 70E–08//160aa//21%//Q28996
3NB6910001290
3NB6910001730
3NB6920000290
3NB6920002810//PUTATIVE ATP-DEPENDENT RNA HELICASE T26G10. 1 IN CHROMOSOME III.//4. 70E–154//442aa//64%//P34580
3NB6920003300//YIP1 PROTEIN.//1. 80E–35//181aa//41%//P53039
3NB6920005450
3NB6920009120
3NB6920010020//REGULATOR OF G-PROTEIN SIGNALING 3 (RGS3) (RGP3).//1.60E–89//179aa//95%//P49796
3NB6920010220//putative C3HC4-type RING zinc finger protein//3. 70E–38//374aa//29%//AAC27460
3NB6920013490
3NB6920014330
3NB6920014710//*Homo sapiens* hepatocellular carcinoma-associated antigen 58 (HCA58) mRNA, complete cds.//5. 40E–130//236aa//100%//AF220416
3NB6920015110//CARG-BINDING FACTOR-A (CBF-A).//7. 50E–140//290aa//90%//Q99020
3NB6920015280//LIGHT-MEDIATED DEVELOPMENT PROTEIN DET1.//4. 60E–55//263aa//35%//P48732
3NB6920015570//ZINC FINGER PROTEIN 135.//7. 90E–129//365aa//60%//P52742
3NB6920016370
3NB6920017190
ADRGL10000020//*Homo sapiens* Kelch-like 1 protein (KLHL1) mRNA, complete cds.//2. 90E–298//546aa//100%//AF252283
ADRGL10000180
ADRGL10000650//ZINC FINGER PROTEIN 135.//2. 20E–76//205aa//64%//P52742
ADRGL10001600//CYTOCHROME P450 XXIB (EC 1. 14. 99. 10) (STEROID 21-HYDROXYLASE) (P450-C21B).//2. 50E–248//397aa//98%//P08686
ADRGL10001650//IMIDAZOLONEPROPIONASE (EC 3. 5. 2. 7) (IMIDAZOLONE-5-PROPIONATE HYDROLASE).//6. 10E–67//418aa//37%//P42084
ADRGL10001820
ADRGL20000740//RHO-GTPASE-ACTIVATING PROTEIN 6 (RHO-TYPE GTPASE-ACTIVATING PROTEIN RHOGAPX-1).//1. 50E–67//327aa//43%//O43182
ADRGL20003230
ADRGL20004280
ASTR010000180//DYNEIN INTERMEDIATE CHAIN 3, CILIARY.//1. 10E–32//207aa//33%//Q16960
ASTR020000950
ASTR020004170//*Homo sapiens* sorting nexin 5 (SNX5) mRNA, complete cds.//5. 20E–47//98aa//100%//AF121855
ASTR020004800
BGGI110002850
BGGI120001610//CELL DIVISION CONTROL PROTEIN 1.//3. 10E–14//218aa//28%//P40986
BGGI120005330//INOSINE-5'-MONOPHOSPHATE DEHYDROGENASE 2 (EC 1. 1. 1. 205) (IMP DEHYDROGENASE 2) (IMPDH-II) (IMPD 2).//1. 40E–218//415aa//80%//P12269
BGGI120005440//*Homo sapiens* snurportin1 mRNA, complete cds.//3. 50E–199//360aa//99%//AF039029
BGGI120006840//*Homo sapiens* sirtuin type 2 (SIRT2) mRNA, complete cds.//7. 60E–197//371aa//98%//AF083107
BGGI120006930//POLYHOMEOTIC-PROXIMAL CHROMATIN PROTEIN.//2. 30E–11//100aa//42%//P39769
BGGI120010970//*Homo sapiens* contactin associated protein (Caspr) mRNA, complete cds.//3. 50E–103//464aa//36%//U87223
BGGI120017140//ZINC FINGER PROTEIN 124 (HZF-16).//1. 60E–127//217aa//100%//Q15973
BNGH410000030//*R. norvegicus* trg mRNA.//3. 10E–111//361aa//60%//X68101
BNGH410000130
BNGH410000170
BNGH410000290
BNGH410000330
BNGH410000340//DIPEPTIDYL PEPTIDASE IV (EC 3. 4. 14. 5) (DPP IV) (THYMOCYTE-ACTIVATING MOLECULE) (THAM).//3. 20E–36//262aa//38%//P28843
BNGH410000390//DYNEIN BETA CHAIN, CILIARY.//4. 80E–136//331aa//72%//P23098
BNGH410000800//*Homo sapiens* zinc finger protein dp mRNA, complete cds.//2. 80E–11//103aa//41%//AF153201
BNGH410001040

BNGH410001180//*Homo sapiens* low density lipoprotein receptor related protein-deleted in tumor (LRPDIT) mRNA, complete cds.//0//752aa//96%//AF176832
BNGH410001370//BRUSH BORDER 61. 9 KD PROTEIN PRECURSOR.//6. 30E−72//555aa//31%//Q05004
BNGH410001530
BNGH410001770//INOSINE-5'-MONOPHOSPHATE DEHYDROGENASE 1 (EC 1. 1. 1. 205) (IMP DEHYDROGENASE 1) (IMPDH-I) (IMPD 1).//2. 10E−270//514aa//99%//P20839
BNGH410001900//*Rattus norvegicus* schlafen-4 (SLFN-4) mRNA, complete cds.//3. 80E−81//568aa//35%//AF168795
BNGH410001980//TETRACYCLINE RESISTANCE PROTEIN, CLASS E (TETA(E)).//1. 20E−15//345aa//26%//Q07282
BNGH420004740
BNGH420005320//ZINC FINGER PROTEIN 36 (ZINC FINGER PROTEIN KOX18) (FRAGMENT).//6. 40E−179//322aa//99%//P17029
BRACE10000200
BRACE10000420//PROTEIN PHOSPHATASE 2C ABI2 (EC 3. 1.3.16) (PP2C)./2.10E−31//202aa//37%//004719
BRACE10000700
BRACE10000730//HYPOTHETICAL 37. 2 KDA PROTEIN C12C2. 09C IN CHROMOSOME II.//9. 60E−05//100aa//34%//Q09749
BRACE10000930//TNF RECEPTOR ASSOCIATED FACTOR 2 (TRAF2).//2. 10E−96//197aa//92%//P39429
BRACE10001150//NUCLEOSOME ASSEMBLY PROTEIN 1-LIKE 2 (BRAIN-SPECIFIC PROTEIN, X-LINKED).//3. 60E−17//144aa//36%//P51860
BRACE10001590
BRACE10001660
BRACE10001690
BRACE10001870//MICROTUBULE-ASSOCIATED PROTEIN 4.//8. 30E−12//49aa//81%//P27816
BRACE20000770
BRACE20001000
BRACE20001410
BRACE20002800//MNN4 PROTEIN.//8. 50E−10//237aa//29%//P36044
BRACE20003320
BRACE20004210
BRACE20005050
BRACE20005250//DRR1 PROTEIN (TU3A PROTEIN).//5. 20E−74//144aa//100%//095990
BRACE20005450
BRACE20005650
BRACE20005770//*Homo sapiens* PHR1 isoform 4 (PHRET1) mRNA, alternatively spliced, complete cds.//5. 80E−48//91aa//100%//AF093249
BRACE20006980//ANKYRIN 2 (BRAIN ANKYRIN) (ANKYRIN B) (ANKYRIN, NONERYTHROID).//2. 40E−16//279aa//30%//Q01484
BRACE20007180//CALCITONIN GENE-RELATED PEPTIDE II PRECURSOR (CGRP-II) (BETA-TYPE CGRP)./2. 70E−61//127aa//99%//P10092
BRACE20008850//CALDESMON (CDM)./3. 50E−08//203aa//29%//P12957
BRACE20009880
BRACE20010650
BRACE20010700
BRACE20011170
BRACE20011430//*Zea mays* clone AGPZm1 arabinogalactan protein (agp) mRNA, partial cds.//3. 70E−06//176aa//33%//AF134579
BRACE20011880
BRACE20013400
BRACE20013520
BRACE20013740
BRACE20013750
BRACE20014230
BRACE20014530//36. 4 KDA PROLINE-RICH PROTEIN.//5. 50E−10//102aa//34%//Q00451
BRACE20014550//HEAT SHOCK FACTOR PROTEIN 1 (HSF 1) (HEAT SHOCK TRANSCRIPTION FACTOR 1) (HSTF 1).//1. 00E−118//229aa//99%//Q00613
BRACE20014770//HUNTINGTIN ASSOCIATED PROTEIN 1 (HAP1).//1. 70E−22//81aa//39%//P54256
BRACE20014920//PROTEIN-TYROSINE PHOSPHATASE-LIKE N PRECURSOR (R-PTP-N) (ISLET CELL AUTOANTIGEN 512) (ICA512).//3. 10E−42//110aa//84%//P56722
BRACE20015080//PROTEIN-LYSINE 6-OXIDASE PRECURSOR (EC1. 4. 3. 13) (LYSYL OXIDASE).//1. 30E−06//110aa//35%//Q05063
BRACE20015430
BRACE20016730//*Mus musculus* mdgI-1 mRNA, complete cds.//3. 00E−54//118aa//83%//AF190624
BRACE20016920
BRACE20017370//*P. vivax* pva1 gene.//2. 70E−20//99aa//49%//X92485
BRACE20018550//B-CELL LYMPHOMA 3-ENCODED PROTEIN (BCL-3 PROTEIN).//9. 20E−16//300aa//30%//P20749
BRACE20018590//NOVEL ANTIGEN 2 (NAG-2) (TSPAN-4).//8. 30E−28//69aa//91%//014817
BRACE20018650
BRACE20018980
BRACE20019440
BRACE20020500
BRACE20020910//ZINC-FINGER PROTEIN RFP (RET FINGER PROTEIN).//1. 10E−31//91aa//49%//Q62158
BRACE20021510
BRACE20021760
BRACE20022020//SERINE/THREONINE-PROTEIN KINASE SNK (EC 2. 7. 1. -) (SERUM INDUCIBLE KINASE).//1. 60E−41//102aa//47%//P53351
BRACE20022270
BRACE20024090//HOMEOBOX PROTEIN MEIS3 (MEIS1-RELATED PROTEIN 2).//1. 50E−108//210aa//89%//P97368
BRACE20024310//P53-INDUCED PROTEIN 11.//5. 00E−37//111aa//69%//014683
BRACE20024680//*Homo sapiens* GaINAc-T9 mRNA for UDP-GaINAc:polypeptide N-acetylgalactosaminyltransferase, complete cds.//3. 00E−153//244aa//99%//AB040672
BRACE20024780//NEURALIZED PROTEIN.//1. 20E−14//95aa//38%//P29503
BRACE20024950
BRACE20025900
BRACE20026350//SODIUM/NUCLEOSIDE COTRANSPORTER (NA(+)/NUCLEOSIDE COTRANSPORTER).//3. 40E−25//53aa//96%//P26430
BRACE20026850//*Homo sapiens* androgen-regulated short-chain dehydrogenase/reductase 1 (ARSDR1) mRNA, complete cds.//6. 50E−120//313aa//72%//AF167438
BRACE20027360//*Homo sapiens* mRNA for fructosamine-3-kinase (FN3K gene)//3. 00E−80//150aa//91%//AJ404615
BRACE20027520

BRACE20027550//REGULATOR OF MITOTIC SPINDLE ASSEMBLY 1 (RMSA-1).//1. 40E−19//128aa//44%//P49646
BRACE20027720//HYDROXYACYLGLUTATHIONE HYDROLASE (EC 3. 1. 2. 6) (GLYOXALASE II) (GLX II).//2. 50E−35//133aa//50%//Q16775
BRACE20027920//L-RIBULOKINASE (EC 2. 7. 1. 16).//5. 20E−40//387aa//29%//P94524
BRACE20027960//*Rattus norvegicus* neurabin mRNA, complete cds.//2. 70E−10//48aa//66%//U72994
BRACE20028120//*Mus musculus* GTPase Rab37 (Rab37) mRNA, complete cds.//4. 60E−48//129aa//78%//AF233582
BRACE20028600
BRACE20028610
BRACE20028960//*Mus musculus* mRNA for Ca2+ dependent activator protein for secretion, complete cds.//6. 10E−195//473aa//74%//D86214
BRACE20030780
BRACE20031100//PATCHED PROTEIN HOMOLOG 1 -(PTC1) (PTC).//3. 00E−23//234aa//25%//Q61115
BRACE20032850
BRACE20033190
BRACE20033980
BRACE20034310
BRACE20034490
BRACE20035160
BRACE20035270
BRACE20035390
BRACE20035940
BRACE20071380//PROBABLE CALCIUM-TRANSPORTING ATPASE 3 (EC 3. 6. 1. 38) (ENDOPLASMIC RETICULUM CA2+-ATPASE).//3. 50E−65//343aa//39%//P39524
BRACE20071530
BRACE20071740//ZINC FINGER PROTEIN 84 (ZINC FINGER PROTEIN HPF2).//4. 90E−157//380aa//61%//P51523
BRACE20071970
BRACE20072010
BRACE20072320
BRACE20072810
BRACE20074010//*Oryctolagus cuniculus* peroxisomal Ca-dependent solute carrier mRNA, complete cds.//2. 30E−140//383aa//65%//AF004161
BRACE20074470//*Mus musculus* partial mRNA for mouse fat 1 cadherin (mfat1 gene).//3. 90E−131//454aa//57%//AJ250768
BRACE20075020
BRACE20075270
BRACE20075380
BRACE20075630
BRACE20076210
BRACE20076410//Mouse mRNA for seizure-related gene product 6 type 2 precursor, complete cds.//5. 10E−173//320aa//94%//D64009
BRACE20076460
BRACE20076630//Dog nonerythroid beta-spectrin mRNA//1. 60E−05//86aa//37%//L02897
BRACE20076850//*Homo sapiens* cell cycle checkpoint protein CHFR mRNA, complete cds.//1. 20E−54//104aa//99%//AF170724
BRACE20077080
BRACE20077270
BRACE20077610
BRACE20077640
BRACE20077670
BRACE20077680
BRACE20077840//Putative Protein that mediates attachment of autophagosomes to microtubules, by similarity to yeast aut2 [Schizosaccharomyces pombe].//1. 00E−08//200aa//26%//CAC00556
BRACE20077980
BRACE20078680//TOLA PROTEIN.//2. 40E−05//140aa//30%//P44678
BRACE20078820//actin-depolymerizing protein N-WASP//5. 50E−06//116aa//37%//S72273
BRACE20079020
BRACE20079530
BRACE20080970
BRACE20081140
BRACE20083800
BRACE20083850//*Rattus norvegicus* NRBF-2 mRNA for nuclear receptor binding factor-2, complete cds.//1. 30E−135//288aa//90%//AB024930
BRACE20084430//PROTEIN DISULFIDE ISOMERASE-RELATED PROTEIN PRECURSOR (EC 5. 3. 4. 1) (PDIR).//8. 30E−102//186aa//98%//Q14554
BRACE20084800
BRACE20084880
BRACE20086530
BRACE20086550//*Homo sapiens* mRNA for GABAB receptor, subunit 1b.//8. 30E−22//55aa//90%//AJ012186
BRACE20087080
BRACE20087540
BRACE20088570
BRACE20089600
BRACE20089990
BRACE20090140
BRACE20091880//*Mus musculus* mRNA for synaptotagmin V, complete cds.//9. 90E−85//166aa//96%//AB026802
BRACE20092120
BRACE20092740
BRACE20092750
BRACE20093070//P120 PROTEIN.//1. 40E−13//121aa//41%//P30999
BRACE20093110
BRACE20093610
BRACE20094370
BRACE20095170
BRAWH10000010//*Homo sapiens* PMEPA1 protein (PMEPA1) mRNA, complete cds.//2. 00E−84//250aa//67%//AF224278
BRAWH10000020//*Homo sapiens* putative hepatic transcription factor (WBSCR14) mRNA, complete cds.//1. 20E−168//345aa//89%//AF156603
BRAWH10000070
BRAWH10000370//UROKINASE PLASMINOGEN ACTIVATOR SURFACE RECEPTOR PRECURSOR (U-PAR) (CD87).//9. 40E−08//155aa//29%//Q05588
BRAWH10000940//*Xenopus laevis* mRNA for NfrI, complete cds.//6. 10E−257//606aa//77%//D86491
BRAWH10001300
BRAWH40001620//*Rattus norvegicus* development-related protein mRNA, complete cds//1. 90E−115//339aa//93%//AF045564
BRAWH10001640//*Homo sapiens* KRAB zinc finger protein (RITA) mRNA, complete cds.//5. 10E−14//57aa//68%//AF272148
BRAWH10001680//Homeotic protein emx2//9. 60E−126//252aa//92%//151737
BRAWH10001740
BRAWH10001800

BRAWH20000340//TRP-185 protein//7. 20E−28//68aa//97%//S62356
BRAWH20000480//*Mus musculus* kinesin motor protein KIFC2 mRNA, complete cds.//1. 50E−120//270aa//85%//U92949
BRAWH20000930
BRAWH20001090//SARCALUMENIN PRECURSOR.//1. 90E−05//363aa//24%//P13666
BRAWH20001770//SERINE HYDROXYMETHYLTRANSFERASE, MITOCHONDRIAL PRECURSOR (EC 2. 1. 2. 1) (SERINE METHYLASE) (GLYCINE HYDROXYMETHYLTRANSFERASE) (SHMT).//3. 20E−41//77aa//100%//P34897
BRAWH20002480
BRAWH20003230//Proline rich protein//2. 00E−29//142aa//52%//CAA48321
BRAWH20004430//Human breast cancer, estrogen regulated LIV-1 protein (LIV-1) mRNA, partial cds.//1. 00E−46//164aa//46%//U41060
BRAWH20004760//*Mus musculus* mRNA for Eos protein, complete cds.//1. 80E−92//180aa//92%//AB017615
BRAWH20005030//REGULATOR OF MITOTIC SPINDLE ASSEMBLY 1 (RMSA-1).//6. 50E−18//103aa//52%//P49646
BRAWH20005220//*Homo sapiens* hD54+ins2 isoform (hD54) mRNA, complete cds.//1. 20E−77//206aa//80%//AF004430
BRAWH20005540
BRAWH20006330//*Homo sapiens* mRNA for zinc finger 2 (ZNF2 gene).//1. 20E−120//214aa//98%//X60152
BRAWH20006510//HYDROXYMETHYLGLUTARYL-COA LYASE (EC 4. 1. 3. 4) (HMG-COA LYASE) (HL) (3-HYDROXY-3-METHYLGLUTARATE-COA LYASE).//1. 60E−96//238aa//73%//P35915
BRAWH20006860//SERINE/THREONINE-PROTEIN KINASE SGK (EC 2. 7. 1. -) (SERUM/GLUCOCORTICOID-REGULATED KINASE).//4. 20E−223//406aa//99%//O00141
BRAWH20006970
BRAWH20008660
BRAWH20008920
BRAWH20009010//Human (c-myb) gene, complete primary cds, and five complete alternatively spliced cds.//9. 70E−28//105aa//59%//U22376
BRAWH20009440//*Arabidopsis thaliana* pollenless3 (178) gene, complete cds; beta-9 tubulin (TUB9) gene, partial cds; and unknown gene.//7. 90E−31//271 aa//34%//AF060248
BRAWH20009840//CYTOCHROME P450 2J2 (EC 1. 14. 14. 1) (CYPIIJ2) (ARACHIDONIC ACID EPOXYGENASE).//1. 10E−146//273aa//98%//P51589
BRAWH20011030
BRAWH20011290//OCCLUDIN.//2. 90E−07//174aa//29%//Q61146
BRAWH20011410//CUTICLE COLLAGEN 2.//2. 30E−05//129aa//35%//P17656
BRAWH20011660//BETA-GALACTOSIDASE PRECURSOR (EC 3. 2. 1. 23) (LACTASE) (ACID BETA-GALACTOSIDASE).//1. 40E−105//421aa//49%//P16278
BRAWH20012030
BRAWH20014180//*Homo sapiens* double-stranded RNA specific adenosine deaminase (ADAR3) mRNA, complete cds.//3. 60E−97//179aa//100%//AF034837
BRAWH20014380
BRAWH20014610
BRAWH20014840//POLYPEPTIDE N-ACETYLGALACTOSAMINYLTRANSFERASE (EC 2. 4. 1. 41) (PROTEIN-UDP ACETYLGALACTOSAMINYLTRANSFERASE) (UDP-GALNAC:POLYPEPTIDE, N-ACETYLGALACTOSAMINYLTRANSFERASE) (GALNAC-T1).//4. 50E−84//511aa//36%//Q07537
BRAWH20015030
BRAWH20036890//*Mus musculus* clone mousel-9 putative protein phosphatase type 2C mRNA, partial cds.//2. 70E−59//120aa//98%//AF117832
BRAWH20036930
BRAWH20038320
BRAWH20040950
BRAWH20047310
BRAWH20052250
BRAWH20059980//BONE MORPHOGENETIC PROTEIN 1 PRECURSOR (EC 3. 4. 24.-) (BMP-1).//8. 60E−37//282aa//32%//P98070
BRAWH20060440
BRAWH20064500//*Homo sapiens* CAGF9 mRNA, partial cds.//8. 00E−25//148aa//51%//U80736
BRAWH20064930
BRAWH20066220//DYNEIN GAMMA CHAIN, FLAGELLAR OUTER ARM.//3. 20E−41//221aa//39%//Q39575
BRAWH20069600
BRAWH20069890//DNA-DIRECTED RNA POLYMERASE II LARGEST SUBUNIT (EC 2. 7. 7. 6) (RPB1) (FRAGMENT).//9. 50E−07//188aa//30%//P11414
BRAWH20074060
BRAWH20076050//LORICRIN.//2. 80E−05//160aa//31%//P18165
BRAWH20087060
BRAWH20089030
BRAWH20089560//Protein-tyrosine-phosphatase (EC 3. 1. 3. 48) TD14//0//736aa//90%//T14355
BRAWH20092270
BRAWH20092610//TLM PROTEIN (TLM ONCOGENE).//3. 90E−15//122aa//43%//P17408
BRAWH20093600
BRAWH20094850
CD34C20000510//Human chitotriosidase precursor mRNA, complete cds.//7. 80E−247//366aa//98%//U29615
CTONG20003030
CTONG20005890//CHANNEL ASSOCIATED PROTEIN OF SYNAPSE-110 (CHAPSYN-110).//3. 10E−18//241aa//31 %//Q15700
CTONG20007710
CTONG20008270
CTONG20011390
CTONG20013200//HYPOTHETICAL PROTEIN C2G11.15C IN-CHROMOSOME I (FRAGMENT).//1. 60E−15//130aa//36%//Q09814
CTONG20013660//GLUCOAMYLASE S1/S2 PRECURSOR (EC 3. 2. 1. 3) (GLUCAN 1,4-ALPHA-GLUCOSIDASE) (1,4-ALPHA-D-GLUCAN GLUCOHYDROLASE).//5. 00E−11//468aa//23%//P08640
CTONG20015330
CTONG20018200//*Mus musculus* NSD1 protein mRNA, complete cds.//0//1061aa//87%//AF064553
CTONG20019110//UBIQUITIN CARBOXYL-TERMINAL HYDROLASE 4 (EC 3. 1. 2. 15) (UBIQUITIN THIOLESTERASE 4) (UBIQUITIN-SPECIFIC PROCESSING PROTEASE 4)

(DEUBIQUITINATING ENZYME 4) (UBIQUITOUS NUCLEAR PROTEIN HOMOLOG).//5. 40E–19//116aa//39%//Q13107
CTONG20019550//*Homo sapiens* mRNA for actin binding protein ABP620, complete cds.//0//1175aa//53%//AB029290
CTONG20020730
CTONG20021430
CTONG20024180//*Homo sapiens* scaffold attachment factor B (SAF-B) mRNA, partial cds.//3. 10E–52//366aa//40%//L43631
CTONG20024530
CTONG20025580//ZINC FINGER PROTEIN 211 (ZINC FINGER PROTEIN C2H2-25).//2. 00E–58//223aa//45%//Q13398
CTONG20027210//VACUOLAR PROTEIN SORTING-ASSOCIATED PROTEIN VPS13.//7. 90E–06//224aa//24%//Q07878
CTONG20028030
CTONG20028160//*Homo sapiens* cadherin-like protein VR20 mRNA, partial cds.//9. 70E–170//290aa//100%//AF169690
CTONG20028200//*Mus musculus* MGA protein mRNA, complete cds.//0//1132aa//85%//AF205935
CTONG20029650
CTONG20037820//GAMMA-AMINOBUTYRIC-ACID RECEPTOR PI SUBUNIT PRECURSOR (GABA(A) RECEPTOR).//4. 30E–94//164aa//93%//O00591
CTONG20047160//*Rattus norvegicus* mRNA for seven transmembrane receptor, complete cds.//1. 10E–26//319aa//29%//AB019120
CTONG20055530//ANKYRIN 2 (BRAIN ANKYRIN) (ANKYRIN B) (ANKYRIN, NONERYTHROID).//1. 90E–59//598aa//30%//Q01484
CTONG20064490//*Drosophila melanogaster* 26S proteasome regulatory complex subunit p42A mRNA, complete cds.//1. 00E–41//108aa//77%//AF145308
D30ST20001840//RNA binding motif protein 9 [*Homo sapiens*].//1. 00E–139//297aa//91%//NP_055124
DFNES20002120//*Mus musculus* tgt mRNA for tRNA-guanine transglycosylase, complete cds.//1. 40E–62//140aa//83%//AB034632
DFNES20002680//MYOSIN HEAVY CHAIN, STRIATED MUSCLE.//9. 00E–26//620aa//24%//P24733
DFNES20002920
DFNES20003350//CELL SURFACE GLYCOPROTEIN 1 PRECURSOR (OUTER LAYER PROTEIN B) (S-LAYER PROTEIN 1).//5. 30E–05//277aa//25%//Q06852
DFNES20004320//*Homo sapiens* ubiquitous TPR-motif protein Y isoform (UTY) gene, partial cds; alternatively spliced.//3. 20E–15//85aa//50%//AF265575
FCBBF10005980//ZINC FINGER PROTEIN 84 (ZINC FINGER PROTEIN HPF2).//3. 20E–151//395aa//57%//P51523
FCBBF10006180
FCBBF10006750
FCBBF10006860
FCBBF10006870//*Mus musculus* Rap2 interacting protein 8 (RPIP8) mRNA, complete cds.//3. 10E–113//456aa//53%//U73941
FCBBF10006910
FCBBF10007320
FCBBF10007600
FCBBF20000940//MONOCYTIC LEUKEMIA ZINC FINGER PROTEIN (ZINC FINGER PROTEIN 220).//2. 70E–05//194aa//28%//Q92794
FCBBF20001050
FCBBF20001950
FCBBF20002320
FCBBF20002760//ALPHA SCRUIN.//2. 70E–05//214aa//24%//Q25390
FCBBF20005760
FCBBF20005910//KINESIN LIGHT CHAIN (KLC).//6. 40E–10//114aa//39%//P46825
FCBBF20006770
FCBBF20007330//DIPEPTIDYL PEPTIDASE IV LIKE PROTEIN (DIPEPTIDYL AMINOPEPTIDASE-RELATED PROTEIN) (DIPEPTIDYLPEPTIDASE VI) (DPPX-L/DPPX-S).//1. 70E–19//96aa//45%//P46101
FCBBF20008080
FCBBF20008150//ZYXIN.//7. 60E–57//350aa//34%//Q04584
FCBBF20009400
FCBBF20009510//ZINC FINGER PROTEIN 7 (ZINC FINGER PROTEIN KOX4) (ZINC FINGER PROTEIN HF.16).//2. 30E–76//225aa//43%//P17097
FCBBF20012110//Leishmania major partial ppg1 gene for proteophosphoglycan.//3. 50E–05//256aa//24%//AJ243460
FCBBF20012990
FCBBF20014800
FCBBF20015380//*Homo sapiens* long chain polyunsaturated fatty acid elongation enzyme (HEL01) mRNA, complete cds.//7. 00E–61//319aa//44%//AF231981
FCBBF20016720
FCBBF20017180
FCBBF20017200
FCBBF40002820//ELECTRON TRANSFER FLAVOPROTEIN BETA-SUBUNIT (BETA-ETF).//3. 60E–121//239aa//99%//P38117
FCBBF50002610//ZINC FINGER PROTEIN 35 (ZFP-35).//1. 40E–137//489aa//50%//P15620
FEBRA20000350//*Mus musculus* MAST205 protein kinase mRNA, complete cds.//6. 20E–71//190aa//76%//U02313
FEBRA20000530//*Drosophila melanogaster* Diablo (dbo) mRNA, complete cds.//6. 40E–58//495aa//32%//AF237711
FEBRA20001050//KINESIN LIGHT CHAIN (KLC).//4. 20E–207//566aa//69%//Q07866
FEBRA20001290//PROBABLE TRNA (5-METHYLAMINOMETHYL-2-THIOURIDYLATE)-METHYLTRANSFERASE (EC 2. 1. 1. 61).//4. 60E–43//82aa//100%//O75648
FEBRA20003110//*Homo sapiens* UDP-GlcNAc:a-3-D-mannoside b1,2-N-acetylglucosaminyltransferase 1. 2 (MGAT1. 2) mRNA, partial cds.//3. 80E–92//1 72aa//98%//AF250859
FEBRA20003300
FEBRA20003770//*Homo sapiens* ankyrin repeat-containing protein (CCM1) mRNA, complete cds.//0//406aa//100%//AF296765
FEBRA20003780
FEBRA20003910
FEBRA20003970//ZINC FINGER PROTEIN 228.//1. 60E–118//423aa//52%//Q9UJU3
FEBRA20003990//ZINC FINGER PROTEIN 45 (BRC1744).//4. 60E–130//502aa//50%//Q02386
FEBRA20004040
FEBRA20004150//DRA PROTEIN (DOWN-REGULATED IN ADENOMA).//2. 70E–30//150aa//37%//P40879
FEBRA20004520
FEBRA20004540//ZINC FINGER PROTEIN 83 (ZINC FINGER PROTEIN HPF1).//2. 40E–252//425aa//99%//P51522

FEBRA20004910
FEBRA20005360//*Homo sapiens* paraneoplastic cancer-testis-brain antigen (MA5) mRNA, complete cds.//5. 50E−75//375aa//44%//AF083116
FEBRA20006560
FEBRA20006800
FEBRA20006900
FEBRA20007330//45 KDA CALCIUM-BINDING PROTEIN PRECURSOR (STROMAL CELL-DERIVED FACTOR 4) (SDF-4).//3. 30E−63//117aa//94%//Q61112
FEBRA20007400
FEBRA20007570//*Homo sapiens* BM-009 mRNA, complete cds.//1. 30E−59//189aa//66%//AF208851
FEBRA20007710
FEBRA20007720//*Mus musculus* strain ICR 90 kDa actin-associated protein palladin mRNA, partial cds.//8. 10E−06//144aa//29%//AF205079
FEBRA20007870//*Homo sapiens* putative transcription factor CR53 (CR53) mRNA, partial cds.//6. 60E−79//144aa//100%//AF017433
FEBRA20008090
FEBRA20008560//HYPOTHETICAL 40. 9 KDA PROTEIN C08B11. 5 IN CHROMOSOME II.//4. 30E−05//91aa//31%//Q09442
FEBRA20008740
FEBRA20008800//SARCALUMENIN PRECURSOR.//2. 10E−07//199aa//30%//P13666
FEBRA20008810//ACTIN 6 (FRAGMENT).//1. 00E−103//369aa//50%//P53459
FEBRA20009010
FEBRA20009590
FEBRA20009720//ZINC FINGER PROTEIN 184 (FRAGMENT).//2. 30E−145//514aa//51%//Q99676
FEBRA20010930//MONOCARBOXYLATE TRANSPORTER 4 (MCT 4).//9. 00E−22//333aa//28%//015374
FEBRA20011330//26S PROTEASOME REGULATORY SUBUNIT S3 (PROTEASOME SUBUNIT P58).//2. 10E−54//113aa//100%//043242
FEBRA20011460//ZINC FINGER PROTEIN 174 (AW-1).//1. 90E−12//60aa//55%//Q15697
FEBRA20011970
FEBRA20012270
FEBRA20012450//NAG14//4. 90E−24//399aa//27%//AF196976
FEBRA20012940
FEBRA20013510
FEBRA20014870
FEBRA20014920//*Mus musculus* pecanex 1 mRNA, complete cds.//6. 50E−120//313aa//72%//AF096286
FEBRA20015840//DELTA-LIKE PROTEIN PRECURSOR (DLK) (PREADIPOCYTE FACTOR 1) (PREF-1) (ADIPOCYTE DIFFERENTIATION INHIBITOR PROTEIN) [CONTAINS: FETAL ANTIGEN 1 (FA1)].//2. 90E−64//323aa//39%//Q09163
FEBRA20015900
FEBRA20015910
FEBRA20017060//Human APEG-1 mRNA, complete cds.//7. 10E−57//113aa//100%//U57099
FEBRA20017150//ZINC-BINDING PROTEIN A33.//4. 00E−10//322aa//21%//Q02084
FEBRA20017900//*Xenopus laevis* RRM-containing protein SEB-4 mRNA, complete cds.//1. 20E−79//180aa//88%//AF223427
FEBRA20019890//HYPOTHETICAL PROTEIN KIAA0167.//1. 70E−180//339aa//56%//Q99490
FEBRA20020860
FEBRA20021910
FEBRA20021940
FEBRA20024290
FEBRA20024420//*Homo sapiens* partial mRNA for choline dehydrogenase (chdh gene).//1. 10E−71//143aa//98%//AJ272267
FEBRA20025250//HYPOTHETICAL 73. 0 KDA PROTEIN IN CLA4-PUS4 INTERGENIC REGION.//1. 40E−09//172aa//29%//P48566
FEBRA20027270
FEBRA20027830
FEBRA20028820
FEBRA20028970
FEBRA20029080
FEBRA20030540//*Halocynthia roretzi* mRNA for HrPET-1, complete cds.//2. 80E−25//155aa//34%//AB029334
FEBRA20031550
FEBRA20033080
FEBRA20034290//RESTIN (CYTOPLASMIC LINKER PROTEIN-170) (CLIP-170).//6. 90E−21//87aa//51%//042184
FEBRA20037070
FEBRA20041100//PHOSPHOLIPASE ADRAB-B PRECURSOR (EC 3. 1.-.-).//1. 10E−119//259aa//83%//Q05017
FEBRA20041910
FEBRA20042240
FEBRA20042370
FEBRA20042930
FEBRA20043250//*Canis familiaris* mRNA for C3VS protein.//1. 90E−191//589aa//66%//X99145
FEBRA20043290//MYOSIN HEAVY CHAIN, CARDIAC MUSCLE ISOFORM (FRAGMENT).//0//975aa//65%//P29616
FEBRA20044120
FEBRA20044430
FEBRA20044900//*R.norvegicus* mRNA for CPG2 protein.//8. 60E−244//509aa//89%//X95466
FEBRA20045920//*Homo sapiens* mRNA for putative sialoglycoprotease type 2.//5. 70E−187//273aa//98%//AJ295148
FEBRA20048180//DRR1 PROTEIN (TU3A PROTEIN).//8. 80E−56//131aa//87%//095990
FEBRA20050140//ZINC FINGER PROTEIN 84 (ZINC FINGER PROTEIN HPF2).//4. 40E−125//505aa//45%//P51523
FEBRA20050790//PROTEIN-TYROSINE PHOSPHATASE STRIATUM-ENRICHED (EC 3. 1. 3. 48) (STEP) (NEURAL-SPECIFIC PROTEIN-TYROSINE PHOSPHATASE) (FRAGMENT).//3. 60E−66//149aa//83%//P54829
FEBRA20052160//PUTATIVE GLUTAMINE-DEPENDENT NAD(+) SYNTHETASE (EC 6. 3. 5. 1) (NAD(+) SYNTHASE [GLUTAMINE-HYDROLYSING]).//6. 50E−33//105aa//64%//P38795
0FEBRA20053770
FEBRA20053800//*Homo sapiens* ubiquitous TPR-motif protein Y isoform (UTY) gene, partial cds; alternatively spliced.//3. 2QE−08//65aa//49%//AF265575
FEBRA20054270
FEBRA20057260
FEBRA20057520
FEBRA20057780//INTEGUMENTARY MUCIN A.1 PRECURSOR (FIM-A.1) (PREPROSPASMOLYSIN).//2. 40E−07//120aa//27%//P10667
FEBRA20057880//LIM domain only 7 isoform c [*Homo sapiens*]//1. 20E−287//545aa//99%//NP_056667
FEBRA20059980

FEBRA20060920//SEGMENT POLARITY PROTEIN DISHEVELLED.//6. 60E-15//84aa//41%//P51140
FEBRA20061500
FEBRA20062700//PUTATIVE novel haloacid dehalogenase-like hydrolase family protein similar to (archaea) bacterial proteins) [Homo sapiens].//0//209aa//100%//CAB43550
FEBRA20063150//Homo sapiens topoisomerase II alpha-4 (TOP2A) mRNA, partial cds.//8. 20E-22//73aa//73%//AF285159
FEBRA20063540
FEBRA20064760//ZINC FINGER PROTEIN 184 (FRAGMENT).//2. 10E-182//547aa//54%//Q99676
FEBRA20066270
FEBRA20066670
FEBRA20067360//HYPOTHETICAL ZINC FINGER PROTEIN KIAA0961.//7. 00E-134//472aa//54%//Q9Y2G7
FEBRA20067930//PERSEPHIN PRECURSOR (PSP).//7. 90E-23//50aa//100%//O60542
FEBRA20068730//Trg protein//1. 00E-82//560aa//37%//I60486
FEBRA20069420//ZINC FINGER PROTEIN 33A (ZINC FINGER PROTEIN KOX31) (KIAA0065) (HA0946) (FRAGMENT).//3. 60E-103//264aa//58%//Q06730
FEBRA20070170//Homo sapiens TRAF4-associated factor 2 mRNA, partial cds.//1. 40E-87//220aa//75%//U83194
FEBRA20072000//MYOSIN II HEAVY CHAIN, NON MUSCLE.//3. 00E-08//645aa//21%//P08799
FEBRA20072800//Human (c-myb) gene, complete primary cds, and five complete alternatively spliced cds.//4. 10E-30//97aa//74%//U22376
FEBRA20074140
FEBRA20074580
FEBRA20075510//RAS-RELATED PROTEIN RAB-6.//1. 00E-36//88aa//88%//P20340
FEBRA20075660//REGULATOR OF MITOTIC SPINDLE ASSEMBLY 1 (RMSA-1).//6. 00E-09//84aa//46%//P49646
FEBRA20076220
HCASM10000210//Plasmodium berghei strain NYU2 merozoite surface protein-1mRNA, partial cds.//1. 50E-08//122aa//28%//AF000413
HCASM10000610//HYPOTHETICAL 63. 9 KD PROTEIN C1F12. 09 IN CHROMOSOME I.//2. 80E-14//116aa//31%//Q10351
HCASM10001150
HCASM20002020
HCASM20002140//G1/S-SPECIFIC CYCLIN D3.//8. 90E-118//226aa//99%//P30281
HCASM20003070
HCASM20005340
HCASM20005360//Macrophage migration inhibitory factor//2. 50E-17//45aa//100%//XP_000858
HEART20000350//Transacylases//7. 50E-35//267aa//35%//AAB94954
HEART20000990
HEART20003090//PTB-ASSOCIATED SPLICING FACTOR (PSF).//3. 70E-07//143aa//30%//P23246
HEART20004110
HEART20004480//TROPONIN T, CARDIAC MUSCLE ISOFORMS (TNTC).//2. 80E-39//81aa//98%//P45379
HEART20004920
HEART20005060//ENAMELIN (TUFTELIN).//1. 80E-23//215aa//30%//P27628
HEART20005200//ANKYRIN 1//5. 00E-24//250aa//37%//P16157
HEART20005680
HHDPC20000550//ADENYLATE KINASE, CHLOROPLAST (EC 2. 7. 4. 3) (ATP-AMP TRANSPHOSPHORYLASE).//1. 60E-14//201aa//24%//P43188
HHDPC20000950//Cricetulus griseus layilin mRNA, complete cds.//8. 00E-177//373aa//84%//AF093673
HHDPC20001150//Mus musculus putative secreted protein ZSIG37 (Zsig37) mRNA, complete cds.//2. 00E-91//199aa//83%//AF192499
HHDPC20001490//Mus musculus partial mRNA for muscle protein 534 (mg534 gene).//2. 10E-80//167aa//88%//AJ250189
HHDPC20003150
HHDPC20004550//H. sapiens PTPL1 mRNA for protein tyrosine phosphatase.//3. 60E-32//371aa//26%//X80289
HHDPC20004560
HHDPC20004620
HLUNG10000240
HLUNG10000300
HLUNG10000370
HLUNG10000640//KARYOGAMY PROTEIN KAR4.//2. 20E-27//324aa//27%//P25583
HLUNG10000760//Mus musculus mRNA for mSox7, complete cds.//9. 90E-186//388aa//87%//AB023419
HLUNG10000990//TRICHOHYALIN.//7. 00E-06//454aa//21%//P22793
HLUNG10001050//MYOTUBULARIN.//4. 60E-12//95aa//37%//Q13496
HLUNG10001100//PISTIL-SPECIFIC EXTENSIN-LIKE PROTEIN PRECURSOR (PELP).//6. 20E-06//117aa//30%//Q03211
HLUNG20000680//ZINC FINGER PROTEIN 157.//6. 30E-104//443aa//45%//P51786
HLUNG20001160//AlG1 PROTEIN.//3. 10E-24//271aa//28%//P54120
HLUNG20001250
HLUNG20001420//Mus musculus putative thymic stromal co-transporter TSCOT mRNA, complete cds.//1. 20E-189//478aa//76%//AF148145
HLUNG20001760
HLUNG20002550//MAST CELL TRYPTASE PRECURSOR (EC 3. 4. 21. 59).//1. 10E-43//178aa//47%//P50342
HLUNG20003140
HLUNG20004120
HLUNG20004800
HLUNG20005010
HSYRA10001190//PROBABLE GYP7 PROTEIN (FRAGMENT).//7. 90E-08//157aa//25%//P09379
HSYRA10001370//ZINC FINGER PROTEIN 184 (FRAGMENT).//1. 70E-149//556aa//50%//Q99676
HSYRA10001480
HSYRA10001680//HYPOTHETICAL HELICASE C28H8. 3 IN CHROMOSOME III.//9. 30E-61//540aa//32%//Q09475
HSYRA10001780
HSYRA20001350//CELL POLARITY PROTEIN TEA1.//9. 10E-16//211 aa//28%//P87061
HSYRA20002480
HSYRA20002530
HSYRA20003470
HSYRA20005100//NAM7 PROTEIN (NONSENSE-MEDIATED MRNA DECAY PROTEIN 1) (UP-FRAMESHIFT SUPPRESSOR 1).//6. 70E-31 //374aa//31%//P30771
HSYRA20006050//MYOSIN HEAVY CHAIN, CLONE 203 (FRAGMENT).//3. 40E-11//282aa//20%//P39922

HSYRA20006290//SKIN SECRETORY PROTEIN XP2 ' PRECURSOR (APEG PROTEIN).//2. 10E−07//168aa//30%//P17437
HSYRA20006400//*Homo sapiens* FRG1 mRNA, complete cds.//1. 00E−50//112aa//91%//L76159
HSYRA20007600
HSYRA20008280
HSYRA20011030
HSYRA20011530
HSYRA20013320//INSULIN-LIKE GROWTH FACTOR BINDING PROTEIN 3 PRECURSOR (IGFBP-3) (IBP-3) (IGF-BINDING PROTEIN 3).//1. 60E−130//236aa//99%//P17936
HSYRA20014200
HSYRA20014760
HSYRA20015740//GLUCOSAMINE-6-PHOSPHATE ISOMERASE (EC 5. 3. 1. 10) (GLUCOSAMINE-6-PHOSPHATE DEAMINASE) (GNPDA) (GLCN6P DEAMINASE) (OSCILLIN).//1. 70E−133//274aa//87%//Q64422
HSYRA20015800
HSYRA20016210
HSYRA20016310//ZINC FINGER PROTEIN 138 (FRAGMENT).//3. 80E−136//237aa//100%//P52744
IMR3210000440//Human transmembrane receptor precursor (PTK7) mRNA, complete cds.//1. 60E−208//388aa//99%//U40271
IMR3210000740
IMR3210000750
IMR3210001580//*Cricetulus griseus layilin* mRNA, complete cds.//2. 30E−177//373aa//84%//AF093673
IMR3210001650
IMR3210002420//ZINC FINGER PROTEIN 33A (ZINC FINGER PROTEIN KOX31) (KIAA0065) (HA0946) (FRAGMENT).//3. 80E−81//281aa//47%//Q06730
IMR3210002660//ZINC/CADMIUM RESISTANCE PROTEIN.//2. 50E−10//148aa//25%//P20107
IMR3220002230//HINT PROTEIN (PROTEIN KINASE C INHIBITOR 1) (PKCI-1) (17 KD INHIBITOR OF PROTEIN KINASE C).//7. 90E−08//97aa//32%//P16436
IMR3220003020//*Mus. musculus* shd mRNA, complete cds.//3. 80E−138//337aa//77%//AB018423
IMR3220006090
IMR3220007420//HYPOTHETICAL ZINC FINGER PROTEIN ZK686. 4 IN CHROMOSOME III.//5. 50E−50//211aa//48%//P34670
IMR3220007750//FOLLISTATIN-RELATED PROTEIN PRECURSOR (TGF-BETA-INDUCIBLE PROTEIN TSC-36).//3. 60E−19//229aa//30%//Q62356
IMR3220007910//SYNAPSINS IA AND IB (BRAIN PROTEIN 4. 1).//5. 00E−07//167aa//31%//P17600
IMR3220008380//METHIONYL-TRNA FORMYLTRANSFERASE, MITOCHONDRIAL PRECURSOR (EC 2. 1. 2. 9) (MTFMT) (FRAGMENT).//1. 10E−147//301aa//90%//077480
IMR3220008590
IMR3220008630//PUTATIVE SPLICING FACTOR, ARGININE/SERINE-RICH 2 (SPLICING FACTOR SC35) (SC-35) (SPLICING COMPONENT, 35 KD).//3. 50E−05//98aa//40%//Q09511
IMR3220009190//METHIONINE AMINOPEPTIDASE 2 (EC 3. 4. 11. 18) (METAP 2) (PEPTIDASE M 2) (INITIATION FACTOR 2 ASSOCIATED 67 KD GLYCOPROTEIN) (P67).//1. 90E−230//418aa//92%//008663
IMR3220009350
IMR3220009530
IMR3220009730//DNA43 PROTEIN.//6. 20E−13//367aa//23%//P32354
IMR3220009840
IMR3220011850
IMR3220012180//*Mus musculus* pseudouridine synthase 3 (Pus3) mRNA, complete cds.//3. 10E−221//483aa//84%//AF266505
IMR3220013170//*Homo sapiens* mRNA for protein phosphatase, complete cds.//9. 10E−41//195aa//48%//AB027004
IMR3220013320//NEUROFILAMENT TRIPLET M PROTEIN (160 KD NEUROFILAMENT PROTEIN) (NF-M).//5. 10E−08//357aa//22%//P08553
IMR3220014350//HYPOTHETICAL PROTEIN KIAA0025.//9. 70E−60//408aa//37%//Q15011
IMR3220014910//*Rattus norvegicus* tricarboxylate carrier-like protein mRNA, complete cds.//3. 90E−43//137aa//57%//AF276997
IMR3220016000
IMR3220017240
KIDNE10000080//*Xenopus laevis* alpha-1 collagen type II mRNA, complete cds.//8. 60E−07//244aa//29%//M63596
KIDNE10000280
KIDNE10000500
KIDNE10001040//SYNTAXIN 7.//1. 10E−32//249aa//32%//015400
KIDNE10001430
KIDNE10001450
KIDNE10001520//*Mus musculus* yolk sac permease-like molecule 1 (YSPL-1) mRNA, complete cds.//6. 40E−73//159aa//77%//U25739
KIDNE20000410//ALANINE-GLYOXYLATE AMINOTRANSFERASE 2 PRECURSOR (EC 2. 6. 1. 44) (AGT 2) (BETA-ALANINE-PYRUVATE AMINOTRANSFERASE) (BETA-ALAAT II).//1. 00E−71//167aa//85%//Q64565
KIDNE20000510//ZINC FINGER PROTEIN 133.//5. 10E−156//503aa//56%//P52736
KIDNE20000700
KIDNE20000850
KIDNE20001670//*Mus musculus* mRNA for RST, complete cds.//6. 80E−123//331aa//72%//AB005451
KIDNE20001920
KIDNE20002440
KIDNE20002450
KIDNE20002660
KIDNE20003150//AQUAPORIN-7 LIKE (AQUAPORIN ADIPOSE) (AQPAP).//1. 80E−44//95aa//92%//014520
KIDNE20003300//Ikaros-like protein//1. 50E−45//160aa//41%//AAC34387
KIDNE20003490//*Mus musculus* putative lysophosphatidic acid acyltransferase mRNA, complete cds.//6. 10E−124//291aa//77%//AF015811
KIDNE20003750//*Mus musculus* mRNA for granuphilin-a, complete cds.//1. 30E−31//173aa//42%//AB025258
KIDNE20004030
KIDNE20004220//*Homo sapiens* topoisomerase II alpha-4 (TOP2A) mRNA, partial cds.//3. 70E−21//76aa//72%//AF285159
KIDNE20004970//TRICHOHYALIN.//1. 50E−06//244aa//27%//P37709
KIDNE20005130//ALANINE--GLYOXYLATE AMINOTRANSFERASE 2 PRECURSOR (EC 2. 6. 1. 44) (AGT 2) (BETA-ALANINE-PYRUVATE AMINOTRANSFERASE) (BETA-ALAAT II).//1. 30E−153//337aa//84%//Q64565

KIDNE20005170//HYPOTHETICAL 49. 1 KD PROTEIN C11D3. 06 IN CHROMOSOME I.//2. 20E–30//247aa//31%//Q10085
KIDNE20005190//TONB PROTEIN.//2. 60E–08//93aa//34%//006432
KIDNE20005740//*Staphylococcus epidermidis* putative cell-surface adhesin SdrF (sdrF) gene, complete cds.//3. 10E–34//372aa//28%//AF245041
KIDNE20031850//Ras association (RaIGDS/AF-6) domain family 2; KIAA0168 gene product [*Homo sapiens*]//4. 00E–66//250aa//59%//NP_055552
KIDNE20033050//PUTATIVE AMIDASE AF1954 (EC 3. 5. 1. 4).//8. 30E–34//242aa//32%//028325
KIDNE20033350
KIDNE20033570
KIDNE20033730//*Homo sapiens* Asef mRNA for APC-stimulated guanine nucleotide exchange factor, complete cds.//3. 90E–184//572aa//61%//AB042199
KIDNE20033770
KIDNE20037520
KIDNE20039410//HYPOTHETICAL 37. 2 KDA PROTEIN C12C2. 09C IN CHROMOSOME II.//3. 20E–19//209aa//22%//Q09749
KIDNE20039940//ZINC FINGER PROTEIN 191.//1. 40E–82//308aa//56%//014754
KIDNE20040340
KIDNE20040540
KIDNE20040840//*Morone saxatilis* myosin heavy chain FM3A (FM3A) mRNA, complete cds.//0//1135aa//64%//AF003249
KIDNE20042620
KIDNE20042940
KIDNE20042950//Human mRNA for prepro-alpha2(I) collagen (COL1A2).//1. 40E–05//96aa//37%//Y00724
KIDNE20043440//Vacuolar protein sorting-associated protein—fission yeast//9. 00E–34//400aa//33%//T39106
KIDNE20044110//*Homo sapiens* vacuolar proton pump 116 kDa accessory subunit (ATP6N1B) mRNA, complete cds, alternatively spliced.//3. 80E–278//322aa//91%//AF245517
KIDNE20045200
KIDNE20045340
KIDNE20045790
KIDNE20046810//*Mus musculus* peroxisomal long chain acyl-CoA thioesterase Ib (Pte1b) gene, exon 3 and complete cds.//2. 80E–87//219aa//73%//AF180801
KIDNE20048280//*Mus musculus* orphan transporter isoform A12 (Xtrp2) mRNA, alternatively spliced, complete cds.//2. 70E–265//600aa//76%//AF075262
KIDNE20048640
KIDNE20048790
KIDNE20049810
KIDNE20050420//LYSOSOMAL TRAFFICKING REGULATOR (BEIGE HOMOLOG).//5. 00E–97//283aa//50%//Q99698
KIDNE20052960//ACTIN, CYTOPLASMIC 1 (BETA-ACTIN).//2. 70E–16//68aa//67%//P12714
KIDNE20053360//*Homo sapiens* antigen NY-CO-31 (NY-CO-31) mRNA, partial cds.//6. 40E–12//66aa//54%//AF039697
KIDNE20054000
KIDNE20054770//*Drosophila melanogaster* minidiscs (mnd) mRNA, complete cds.//4. 80E–69//474aa//34%//AF139834
KIDNE20056290//*Bos taurus* mRNA for mitochondrial aralkyl acylCoA:amino acid N-acyltransferase.//6. 40E–58//297aa//40%//AJ223301
KIDNE20056760//NEURONAL PROTEIN.//6. 50E–44//118aa//75%//P41737
KIDNE20059080//Plakophilin 4 [*Homo sapiens*].//0//669aa//98%//NP_003619
KIDNE20059370
KIDNE20060140//*Rattus norvegicus* selective LIM binding factor mRNA, complete cds.//1. 30E–255//339aa//94%//AF226993
KIDNE20060300//*Gallus gallus* syndesmos mRNA, complete cds.//3. 10E–42//149aa//62%//AF095446
KIDNE20060530//*Mus musculus* mRNA for acetylglucosaminyltransferase-like protein.//3. 70E–252//633aa//69%//AJ006278
KIDNE20060620
KIDNE20061490//*Xenopus laevis* RING finger protein mRNA, complete cds.//6. 80E–19//136aa//40%//U63817
KIDNE20062480
KIDNE20062990//B0B1 PROTEIN (BEM1-BINDING PROTEIN).//8. 00E–06//332aa//22%//P38041
KIDNE20063530
KIDNE20063760//GAMMA-GLUTAMYLTRANSPEPTIDASE 1 PRECURSOR (EC 2. 3. 2. 2) (GAMMA-GLUTAMYLTRANSFERASE 1).//7. 70E–20//62aa//83%//P19440
KIDNE20066520
KIDNE20067600//PROSTAGLANDIN F2-ALPHA RECEPTOR REGULATORY PROTEIN PRECURSOR (PROSTAGLANDIN F2-ALPHA RECEPTOR ASSOCIATED PROTEIN).//1. 90E–23//293aa//26%//Q62786
KIDNE20067750//*Homo sapiens* PTOV1 (PTOV1) gene, complete cds.//7. 60E–62//283aa//53%//AF238381
KIDNE20068800//ACTIN INTERACTING PROTEIN 2.//4. 60E–33//143aa//51%//P46681
KIDNE20070050
KIDNE20070770
KIDNE20071860
KIDNE20073280//*L.mexicana* lmsap2 gene for secreted acid phosphatase 2 (SAP2).//3. 30E–05//365aa//23%//Z46970
KIDNE20073520//GLUCOAMYLASE S1/S2 PRECURSOR (EC 3. 2. 1. 3) (GLUCAN 1,4-ALPHA-GLUCOSIDASE) (1,4-ALPHA-D-GLUCAN GLUCOHYDROLASE).//3. 00E–15//536aa//23%//P08640
KIDNE20073560
KIDNE20074220
KIDNE20075690//CLAUDIN-10 (OSP LIKE PROTEIN).//6. 60E–90//224aa//77%//P78369
KIDNE20078100//DEOXYURIDINE 5'-TRIPHOSPHATE NUCLEOTIDOHYDROLASE (EC 3. 6. 1. 23) (DUTPASE) (DUTP PYROPHOSPHATASE).//7. 80E–16//100aa//44%//041033
KIDNE20078110//ZINC FINGER PROTEIN 202.//3. 10E–67//427aa//40%//095125
LIVER10000580
LIVER10000670//UROCANATE HYDRATASE (EC 4. 2. 1. 49) (UROCANASE) (IMIDAZOLONEPROPIONATE HYDROLASE).//1. 50E–87//380aa//35%//P53385
LIVER10000790//*Rattus norvegicus* fertility related protein WMP1 mRNA, complete cds.//2. 70E–82//254aa//65%//AF094609
LIVER10000990
LIVER10001040//*Rattus norvegicus* kidney-specific protein (KS) mRNA, complete cds.//6. 00E–149//333aa//79%//AF062389
LIVER10001110
LIVER10001750

LIVER10002300//NADH-UBIQUINONE OXIDOREDUCTASE 51 KD SUBUNIT PRECURSOR (EC 1. 6. 5. 3) (EC 1. 6. 99. 3) (COMPLEX I-51 KD) (CI-51 KD).//1. 80E-99//183aa//100%//P49821
LIVER10002780
LIVER10003030
LIVER10004330//*Homo sapiens* mRNA for neuropathy target esterase.//1. 30E-256//710aa//68%//AJ004832
LIVER10005420//*Mus musculus* TAGL-alpha mRNA, complete cds.//1. 20E-204//373aa//76%//AF149837
LIVER20000330//TUMOR NECROSIS FACTOR, ALPHA-INDUCED PROTEIN 1, ENDOTHELIAL (B12 PROTEIN).//1. 80E-10//193aa//27%//Q13829
LIVER20000370//ALPHA-1B-GLYCOPROTEIN.//5. 00E-159//304aa//96%//P04217
LIVER20004160
LIVER20004460
LIVER20005150
MAMGL10000320
MAMGL10000350
MAMGL10000560
MAMGL10001780//PUTATIVE PRE-MRNA SPLICING FACTOR RNA HELICASE (DEAH BOX PROTEIN 15) (ATP-DEPENDENT RNA HELICASE #46).//2. 10E-80//166aa//92%//O43143
MAMGL10001820//SEGMENT POLARITY PROTEIN DISHEVELLED.//1. 10E-12//84aa//41%//P51140
MAMGL10001840
MESAN10000350//MAJOR SURFACE-LABELED TROPHOZOITE ANTIGEN PRECURSOR.//2. 10E-06//179aa//29%//P21849
MESAN10001010//Rat trg gene product//6. 00E-94//600aa//36%//160486
MESAN10001470
MESAN10001800//BB1=malignant cell expression-enhanced gene/tumor progression-enhanced gene [human, UM-UC-9 bladder carcinoma cell line, mRNA, 1897 nt].//1. 60E-162//348aa//87%//S82470
MESAN20000920//Guanylate kinase-interacting protein 1 Maguin-1, membrane-associated//7. 60E-155//477aa//62%//T18293
MESAN20001490//HYPOTHETICAL 175. 8 KD PROTEIN IN GND1-IKI1 INTERGENIC REGION.//6. 70E-163//346aa//58%//P38873
MESAN20002670
MESAN20002910//HISTIDYL-TRNA SYNTHETASE (EC 6. 1. 1. 21) (HISTIDINE-TRNA LIGASE) (HISRS).//3. 60E-98//202aa//96%//P12081
MESAN20003370
MESAN20005010//*Homo sapiens* DNA cytosine methyltransferase 3 alpha (DNMT3A) mRNA, complete cds.//6. 60E-09//95aa//33%//AF067972
NB9N410000470//*Homo sapiens* NY-REN-45 antigen mRNA, complete cds.//9. 70E-247//250aa//99%//AF155110
NB9N410001210
NB9N410001350//RAS-RELATED PROTEIN RAB-1A (YPT1-RELATED PROTEIN).//1. 00E-70//109aa//100%//P11476
NB9N410001460
NB9N420000420
NB9N420001040//*Mus musculus* Shc binding protein (mPAL) mRNA, complete cds.//4. 40E-286//672aa//77%//AF017152
NB9N420004950//PROBABLE NUCLEAR ANTIGEN.//5. 00E-05//246aa//31%//P33485
NESOP10000870//HOMEOBOX PROTEIN SAX-1 (CHOX-3) (FRAGMENT).//1. 70E-05//88aa//38%//P19601
NHNPC10000840//*Homo sapiens* poly-U binding splicing factor PUF60 (PUF60) mRNA, partial cds.//6. 80E-196//380aa//99%//AF190744
NHNPC10001010
NHNPC10001240//PAIRED MESODERM HOMEOBOX PROTEIN 2A (PAIRED-LIKE HOMEOBOX 2A) (PHOX2A HOMEODOMAIN PROTEIN).//8. 00E-05//109aa//28%//Q62066
NHNPC20002060//Bovine viral diarrhea virus type 2 strain BVDV2-SD1630c polyprotein gene, partial cds.//8. 70E-77//153aa//92%//AF268178
NHNPC20002120//ZINC FINGER PROTEIN 83 (ZINC FINGER PROTEIN HPF1).//2. 20E-130//357aa//63%//P51522
NT2NE10000040
NT2NE10000140//*Schizosaccharomyces pombe* caffeine-induced death protein 1 (cid1)mRNA, complete cds.//1. 00E-31//350aa//29%//AF105076
NT2NE10000180//SUPPRESSOR PROTEIN SRP40.//2. 50E-06//219aa//23%//P32583
NT2NE10000230
NT2NE10000630//*Gallus gallus* Dach2 protein (Dach2) mRNA, complete cds.//1. 90E-147//194aa//78%//AF198349
NT2NE10000730//RAB GERANYLGERANYLTRANSFERASE ALPHA SUBUNIT (EC 2. 5. 1.-) (RAB GERANYL-GERANYLTRANSFERASE ALPHA SUBUNIT) (RAB GG TRANSFERASE) (RAB GGTASE).//3. 30E-07//142aa//33%//Q92696
NT2NE10000830//POSSIBLE GUSTATORY RECEPTOR CLONE PTE01 (FRAGMENT).//2. 40E-56//182aa//62%//P35894
NT2NE10001200
NT2NE10001630
NT2NE10001850//UDP-N-ACETYLGLUCOSAMINE-PEPTIDE N-ACETYLGLUCOSAMINYLTRANSFERASE 110 KDA SUBUNIT (EC 2. 4. 1.-) O-GLCNAC TRANSFERASE P110 SUBUNIT).//6. 80E-30//395aa//28%//P56558
NT2NE20000380
NT2NE20000560
NT2NE20000640
NT2NE20001740
NT2NE20002140//DUAL SPECIFICITY PROTEIN PHOSPHATASE 8 (EC 3. 1. 3. 48) (EC 3. 1. 3. 16) (NEURONAL TYROSINE THREONINE PHOSPHATASE 1).//1. 00E-131//487aa//51%//O09112
NT2NE20002590//OOCYTE ZINC FINGER PROTEIN XLCOF6. 1 (FRAGMENT).//6. 30E-30//77aa//53%//P18750
NT2NE20002990//69 KD ISLET CELL AUTOANTIGEN (ICA69) (ISLET CELL AUTOANTIGEN 1).//3. 30E-113//335aa//57%//Q05084
NT2NE20003270//GLUCOAMYLASE S1/S2 PRECURSOR (EC 3. 2. 1. 3) (GLUCAN 1,4-ALPHA-GLUCOSIDASE) (1,4-ALPHA-D-GLUCAN GLUCOHYDROLASE).//7. 00E-21//739aa//22%//P08640
NT2NE20003690//PROPIONYL-COA CARBOXYLASE ALPHA CHAIN PRECURSOR (EC 6. 4. 1. 3) (PCCASE) (PROPANOYL-COA:CARBON DIOXIDE LIGASE).//1. 80E-26//68aa//86%//P05165
NT2NE20003840//MICRONUCLEAR LINKER HISTONE POLYPROTEIN (MIC LH) [CONTAINS: LINKER HISTONE PROTEINS ALPHA, BETA, DELTA AND GAMMA].//7. 80E-10//366aa//22%//P40631

NT2NE20003920
NT2NE20004550//sdk (sidekick) protein//4. 90E–11//177aa//31%//T13924
NT2NE20004700
NT2NE20005170//*Homo sapiens* ciliary dynein heavy chain 9 (DNAH9) mRNA, complete cds.//1. 20E–103//226aa//90%//AF257737
NT2NE20005360//40S RIBOSOMAL PROTEIN SA (P40) (34/67 KD LAMININ RECEPTOR) (COLON CARCINOMA LAMININ-BINDING PROTEIN) (NEM/1CHD4).//1. 50E–47//91aa//98%//P08865
NT2NE20005500
NT2NE20005860//*Rattus norvegicus* endo-alpha-D-mannosidase (Enman) mRNA, complete cds.//1. 70E–85//207aa//69%//AF023657
NT2NE20006360
NT2NE20006580//*Homo sapiens* mRNA for RET finger protein-like 2//1. 10E–152//288aa//98%//AJ010231
NT2NE20007060
NT2NE20007630
NT2NE20007870
NT2NE20008020
NT2NE20008090//ZINC FINGER PROTEIN 85 (ZINC FINGER PROTEIN HPF4) (HTF1).//1. 90E–207//511aa//71%//Q03923
NT2NE20009800
NT2NE20011560
NT2NE20012470
NT2NE20013240
NT2NE20013370//*Homo sapiens* estrogen-responsive B box protein (EBBP) mRNA, complete cds.//4. 30E–208//394aa//97%//AF096870
NT2NE20013640
NT2NE20013720//*Homo sapiens* mRNA for putative ribulose-5-phosphate-epimerase, partial cds.//7. 90E–58//116aa//98%//AJ224326
NT2NE20014030
NT2NE20014280
NT2NE20014350
NT2NE20015300
NT2NE20016230
NT2NE20016260//*Homo sapiens* G-protein coupled receptor RE2 mRNA, complete cds.//2. 00E–148//270aa//100%//AF091890
NT2NE20016340//NADH-UBIQUINONE OXIDOREDUCTASE 9 KD SUBUNIT PRECURSOR (EC 1. 6. 5. 3) (EC 1. 6. 99. 3) (COMPLEX I-9 KD) (CI-9 KD).//5. 50E–26//86aa//68%//P56181
NT2NE20016480
NT2NE20016660//PUTATIVE ATP-DEPENDENT RNA HELICASE YDL031W.//3. 90E–15//176aa//30%//Q12389
NT2NE20016970//MSF1 PROTEIN.//3. 00E–23//169aa//34%//P35200
NT2NE20034080//*Rattus norvegicus* neurestin alpha mRNA, complete cds.//3. 70E–258//449aa//99%//AF086607
NT2NE20035690//*Homo sapiens* phosphoinositol 3-phosphate-binding protein-2 (PEPP2) mRNA, complete cds.//1. 60E–180//227aa//98%//AF302150
NT2NE20044900
NT2NE20047160//*Homo sapiens* AD-017 protein mRNA, complete cds.//2. 70E–91//357aa//47%//AF157318
NT2NE20053710
NT2NE20054410//SPLICEOSOME ASSOCIATED PROTEIN 49 (SAP 49) (SF3B53).//4. 50E–06//121aa//33%//Q15427
NT2NE20055170//*Homo sapiens* torsinA (DYT1) mRNA, complete cds.//9. 50E–159//232aa//89%//AF007871
NT2NE20057200//*Mus musculus* Ubc6p homolog mRNA, complete cds.//3. 80E–108//222aa//91%//U93242
NT2RI10000160
NT2RI10000270
NT2RI10000480//*Homo sapiens* MKP-1 like protein tyrosine phosphatase mRNA, complete cds.//8. 30E–49//179aa//50%//AF038844
NT2RI10001640
NT2RI20000640
NT2RI20002700
NT2RI20002820//NUCLEOLAR AUTOANTIGEN N055.//5. 00E–243//437aa//100%//Q92791
NT2RI20002940
NT2RI20003410//ZINC FINGER PROTEIN 43 (ZINC PROTEIN HTF6).//9. 30E–226//578aa//70%//P28160
NT2RI20004120//CREB-BINDING PROTEIN.//4. 40E–05//170aa//30%//Q92793
NT2RI20004210//ZINC FINGER PROTEIN 75.//1. 10E–96//225aa//76%//P51815
NT2RI20005970
NT2RI20006690//TRICHOHYALIN.//7. 10E–17//222aa//32%//P37709
NT2RI20006710
NT2RI20006850//HISTONE H1. 2 (H1 VAR. 1) (H1C).//3. 30E–05//154aa//25%//P15864
NT2RI20007380
NT2RI20008650
NT2RI20009740
NT2RI20010100//FATTY ACYL-COA HYDROLASE PRECURSOR, MEDIUM CHAIN (EC 3. 1. 2. 14) (THIOESTERASE B).//1. 10E–114//425aa//46%//Q04791
NT2RI20010830//ZINC FINGER PROTEIN 84 (ZINC FINGER PROTEIN HPF2).//2. 30E–174//554aa//51%//P51523
NT2RI20010910//SPLICING FACTOR, ARGININE/SERINE-RICH 4 (PRE-MRNA SPLICING FACTOR SRP75).//3. 40E–22//195aa//36%//Q08170
NT2RI20012350
NT2RI20012440
NT2RI20013420//*Mus musculus* cyclin ania-6b mRNA, partial cds.//2. 70E–73//163aa//91%//AF211859
NT2RI20013850//*Homo sapiens* P38IP (P38IP) mRNA, complete cds.//7. 70E–101//213aa//95%//AF093250
NT2RI20014090//DYSTROPHIN.//3. 60E–15//546aa//20%//P11531
NT2RI20014100
NT2RI20014490//*Mus musculus* retinoic acid-responsive protein (Stra6) mRNA, complete cds.//1. 30E–263//672aa//73%//AF062476
NT2RI20014500//TRICHOHYALIN.//4. 80E–19//610aa//23%//Q07283
NT2RI20015190//*Homo sapiens* misato mRNA, partial cds.//7. 60E–149//271aa//100%//AF272833
NT2RI20015400//Alcohol dehydrogenase/ribitol dehydrogenase//4. 30E–107//469aa//44%//AAB93456
NT2RI20015950//*Zea mays* clone AGPZm1 arabinogalactan protein (agp) mRNA, partial cds.//5. 60E–05//180aa//32%//AF134579
NT2RI20016210//Probable transposase—human transposon MER37//3. 50E–19//156aa//35%//S72481
NT2RI20016570
NT2RI20017260
NT2RI20018460//basic domain/leucine zipper transcription factor//3. 00E–52//203aa//59%//AAA65688

NT2RI20018660//*Mus musculus* erythroid membrane-associated protein ERMAP (Ermap) mRNA, complete cds.//9. 20E–187//385aa//72%//AF153906
NT2RI20020220//VARIANT-SURFACE-GLYCOPROTEIN PHOSPHOLIPASE C (EC 3. 1. 4. 47) (VSG LIPASE) (GLYCOSYLPHOSPHATIDYLINOSITOL-SPECIFIC PHOSPHOLIPASE C) (GPI-PLC).//5. 60E–21//271aa//27%//015886
NT2RI20020410//SALIVARY PROLINE-RICH PROTEIN P0 (ALLELE K) [CONTAINS: PEPTIDE P-D] (FRAGMENT).//1. 20E–05//127aa//32%//P10162
NT2RI20021520
NT2RI20022430
NT2RI20022520
NT2RI20022700//X123 protein//7. 20E–80//165aa//97%//168673
NT2RI20025170//*Homo sapiens* PAR3 (PAR3) mRNA, complete cds.//1. 30E–113//373aa//45%//AF252293
NT2RI20025300//GLUCOAMYLASE S1/S2 PRECURSOR (EC 3. 2. 1. 3) (GLUCAN 1,4-ALPHA-GLUCOSIDASE) (1,4-ALPHA-D-GLUCAN GLUCOHYDROLASE).//1. 40E–14//628aa//21%//P08640
NT2RI20025410//ZINC FINGER PROTEIN 135.//3. 90E–72//301aa//42%//P52742
NT2RI20025540//NUCLEAR AUTOANTIGENIC SPERM PROTEIN (NASP).//1. 1E–312//604aa//98%//P49321
NT2RI20025850//PUTATIVE 90. 2 KD ZINC FINGER PROTEIN IN CCA1-ADK2 INTERGENIC REGION.//1. 40E–73//246aa//42%//P39956
NT2RI20026540
NT2RI20028020
NT2RI20028520
NT2RI20029260//ARP2/3 COMPLEX 16 KDA SUBUNIT (P16-ARC).//1. 00E–52//154aa//68%//015511
NT2RI20029580//*Homo sapiens* mRNA for copine VI protein.//1. 00E–207//425aa//73%//AJ133798
NT2RI20029700
NT2RI20030110//*Mus musculus* clone:2–65 mRNA, complete cds.//2. 30E–28//124aa//50%//AB030198
NT2RI20030190
NT2RI20030510
NT2RI20030670
NT2RI20031540//DXS6673E PROTEIN.//2. 80E–05//240aa//22%//Q14202
NT2RI20032050//*Homo sapiens* transportin 2 mRNA, complete cds.//0//663aa//98%//AF019039
NT2RI20032220//INTRACELLULAR PROTEIN TRANSPORT PROTEIN US01.//4. 90E–16//582aa//23%//P25386
NT2RI20033010//*Homo sapiens* UDP-GlcNAc:a-3-D-mannoside b1,2-N-acetylglucosaminyltransferase 1. 2 (MGAT1. 2) mRNA, partial cds.//1. 40E–293//579aa//93%//AF250859
NT2RI20033040
NT2RI20033380
NT2RI20033440//PRESYNAPTIC PROTEIN SAP97 (SYNAPSE-ASSOCIATED PROTEIN 97) (DISCS, LARGE HOMOLOG 1).//2. 20E–08//128aa//36%//Q12959
NT2RI20033830//*Homo sapiens* SGC32445 protein (SGC32445) mRNA, complete cds.//1. 80E–67//134aa//100%//AF251041
NT2RI20035560
NT2RI20036780//SERINE PROTEASE PC6 PRECURSOR (EC 3. 4. 21.-) (SUBTILISIN/KEXIN-LIKE PROTEASE PC5) (CONVERTASE PC5).//0//633aa//97%//P41413
NT2RI20036950//TRICHOHYALIN.//1. 70E–13//313aa//25%//P37709
NT2RI20037510//FORMAMIDOPYRIMIDINE-DNA GLYCOSYLASE (EC 3. 2. 2. 23) (FAPY-DNA GLYCOSYLASE).//1. 20E–05//238aa//28%//P74290
NT2RI20040590
NT2RI20041900//REGULATOR OF MITOTIC SPINDLE ASSEMBLY 1 (RMSA-1).//3. 20E–13//108aa//44%//P49646
NT2RI20042840
NT2RI20043040//*Homo sapiens* NY-REN-2 antigen mRNA, complete cds.//2. 80E–188//539aa//65%//AF155095
NT2RI20043980
NT2RI20044420
NT2RI20046060
NT2RI20047830
NT2RI20048400
NT2RI20049160
NT2RI20049840
NT2RI20049850
NT2RI20050610
NT2RI20050870//*Homo sapiens* putative anion transporter 1 mRNA, complete cds.//8. 10E–262//533aa//96%//AF279265
NT2RI20051500//*Mus musculus* ST6GaINAc V mRNA for GD1 alpha synthase, complete cds.//2. 40E–168//336aa//90%//AB030836
NT2RI20053350//DNA REPAIR/TRANSCRIPTION PROTEIN MET18/MMS19.//2. 00E–23//234aa//32%//P40469
NT2RI20053680//*Homo sapiens* NY-REN-36 antigen mRNA, partial cds.//5. 80E–62//124aa//100%//AF155106
NT2RI20055640//*Mus musculus* mRNA for ganglioside-induced differentiation associated protein 1.//2. 50E–100//319aa//58%//Y17850
NT2RI20056280
NT2RI20056470//KERATIN, TYPE II CYTOSKELETAL 4 (CYTOKERATIN 4) (K4) (CK4).//2. 40E–278//534aa//99%//P19013
NT2RI20057230//SPLICING FACTOR, ARGININE/SERINE-RICH 4 (PRE-MRNA SPLICING FACTOR SRP75).//3. 00E–28//241aa//36%//Q08170
NT2RI20058110//CELL DIVISION CONTROL PROTEIN 25.//3. 30E–18//419aa//25%//P04821
NT2RI20058510//PLECTIN.//3. 50E–07//551aa//21%//P30427
NT2RI20060710//ZINC FINGER PROTEIN ZIC4 (ZINC FINGER PROTEIN OF THE CEREBELLUM 4).//2. 10E–153//312aa//86%//Q61467
NT2RI20060720//HYPOTHETICAL PROTEIN KIAA0179.//0//692aa//99%//Q14684
NT2RI20061270
NT2RI20061830//Proline-rich protein M14 precursor//1. 50E–17//170aa//37%//A28996
NT2RI20062100//*Mus musculus* shd mRNA, complete cds.//1. 00E–137//337aa//77%//AB018423
NT2RI20063450
NT2RI20064120//*Rattus norvegicus* mRNA for CDCreI-1A, complete cds.//6. 70E–148//280aa//98%//AB027143
NT2RI20064870
NT2RI20065060//*Drosophila melanogaster* rudimentary gene, intron 3; anon-15AB gene, complete cds.//1. 40E–07//212aa//23%//AF172941
NT2RI20065530
NT2RI20066670

NT2RI20066790
NT2RI20066820//Human WW domain binding protein-1 mRNA, complete cds.//5. 70E-46//181aa//46%//U79457
NT2RI20067030//*Homo sapiens* nolp mRNA, complete cds.//1. 80E-85//406aa//51%//AB017800
NT2RI20067350//*Neofelis nebulosa* strain nnex zinc finger protein Zfx (Zfx) gene, partial cds.//2. 10E-23//245aa//27%//AF252979
NT2RI20067880
NT2RI20068250
NT2RI20068550//*Homo sapiens* RNA helicase (RIG-I) mRNA, complete cds.//1. 20E-52//340aa//34%//AF038963
NT2RI20070480//*Mus musculus* DXImx48e protein (DXImx48e) mRNA, complete cds.//3. 40E-169//467aa//72%//AF229644
NT2RI20070840
NT2RI20070960//PROTO-ONCOGENE DBL PRECURSOR [CONTAINS: MCF2].//4. 10E-30//431aa//27%//P10911
NT2RI20071160
NT2RI20071330//ZINC FINGER PROTEIN 91 (ZINC FINGER PROTEIN HTF10) (HPF7).//2. 80E-240//647aa//64%//Q05481
NT2RI20071480
NT2RI20072140
NT2RI20072540//*Arabidopsis thaliana* ZCF61 mRNA, complete cds.//2. 20E-12//113aa//35%//AB028228
NT2RI20073030
NT2RI20073840//*Homo sapiens* mixed lineage kinase mRNA, complete cds.//2. 30E-179//362aa//93%//AF238255
NT2RI20073860
NT2RI20074390//ZINC FINGER PROTEIN 84 (ZINC FINGER PROTEIN HPF2).//2. 30E-97//489aa//41%//P51523
NT2RI20074690//*Homo sapiens* NY-REN-58 antigen mRNA, complete cds.//4. 00E-221//438aa//99%//AF155115
NT2RI20074980//*Homo sapiens* carboxypeptidase Z precursor, mRNA, complete cds.//3. 10E-189//357aa//96%//U83411
NT2RI20075070
NT2RI20075720
NT2RI20075890
NT2RI20077230//*Homo sapiens* BRI3 mRNA, complete cds.//1. 80E-114//182aa//99%//AF272043
NT2RI20077290
NT2RI20077510
NT2RI20077540//INTESTINAL MEMBRANE A4 PROTEIN (DIFFERENTIATION-DEPENDENT PROTEIN A4) (PROTEOLIPID PROTEIN 2).//2. 30E-12//111aa//33%//Q04941
NT2RI20078270
NT2RI20078790//HOMEOBOX PROTEIN HOX-A4 (CHOX-1. 4).//7. 80E-08//83aa//43%//P17277
NT2RI20078840//ARS BINDING PROTEIN 1.//1. 50E-17//313aa//27%//P49777
NT2RI20078910//DMR-N9 PROTEIN.//1. 40E-122//398aa//59%//Q08274
NT2RI20080500//BASEMENT MEMBRANE-SPECIFIC HEPARAN SULFATE PROTEOGLYCAN CORE PROTEIN PRECURSOR (HSPG) (PERLECAN) (PLC).//5. 90E-43//528aa//28%//P98160
NT2RI20081880//*Mus musculus* Mporc-b mRNA for porcupine-B, complete cds.//4. 40E-64//125aa//97%//AB036746
NT2RI20082210//CORNIFIN B (SMALL PROLINE-RICH PROTEIN 1B) (SPR1B) (SPR1B).//4. 70E-12//110aa//37%//Q62267
NT2RI20083360
NT2RI20083960//*Homo sapiens* mRNA for SH3 binding protein, complete cds.//3. 60E-31//159aa//44%//AB005047
NT2RI20084810//1-ACYL-SN-GLYCEROL-3-PHOSPHATE ACYLTRANSFERASE ALPHA (EC 2. 3. 1. 51) (1-AGP ACYLTRANSFERASE) (1-AGPAT) (LYSOPHOSPHATIDIC ACID ACYLTRANSFERASE-ALPHA) (LPAAT-ALPHA).//4. 70E-60//114aa//99%//Q99943
NT2RI20085260
NT2RI20085980//MILK FAT GLOBULE-EGF FACTOR 8 PRECURSOR (MFG-E8) (MGP57/53) (PAS-6/PAS-7 GLYCOPROTEIN) (MFGM) (SPERM SURFACE PROTEIN SP47) (BP47) (COMPONENTS 15/16).//5. 40E-31//174aa//41%//Q95114
NT2RI20086560
NT2RI20087140//*Homo sapiens* PR-domain zinc finger protein 5 (PRDM5) mRNA, complete cds.//6. 10E-51//101aa//99%//AF272897
NT2RI20087490//SPLICEOSOME ASSOCIATED PROTEIN 49 (SAP 49) (SF3B53).//2. 00E-08//156aa//37%//Q15427
NT2RI20087910//PROBABLE URACIL PHOSPHORIBOSYLTRANSFERASE (EC 2. 4. 2. 9) (UMP PYROPHOSPHORYLASE) (UPRTASE).//1. 80E-42//159aa//54%//O13867
NT2RI20088010
NT2RI20088120//AXONEME-ASSOCIATED PROTEIN MST101(2).//4. 00E-05//185aa//24%//Q08696.
NT2RI20089420//NEURAL CELL ADHESION MOLECULE L1 PRECURSOR (N-CAM L1).//3. 00E-07//104aa//31%//Q05695
NT2RI20090650//ZINC FINGER PROTEIN 26 (ZFP-26) (MKR3 PROTEIN) (FRAGMENT).//2. 10E-30//194aa//37%//P10076
NT2RI20090660//PLECTIN.//7. 20E-14//450aa//24%//P30427
NT2RI20090830
NT2RI20091440
NT2RI20092150//ZINC FINGER PROTEIN 165.//3. 10E-46//179aa//56%//P49910
NT2RI20092890//CARBOXYPEPTIDASE N 83 KD CHAIN (CARBOXYPEPTIDASE N REGULATORY SUBUNIT) (FRAGMENT).//3. 70E-29//293aa//31%//P22792
NT2RI20094060//*Homo sapiens* rec mRNA, complete cds.//1. 40E-112//293aa//62%//AB023584
NT2RP60000080//*Homo sapiens* Pig11 (PIG11) mRNA, complete cds.//6. 60E-38//117aa//71%//AF010315
NT2RP60000170
NT2RP60000320
NT2RP60000350//*Homo sapiens* mRNA for SH3 binding protein, complete cds.//1. 30E-54//253aa//45%//AB005047
NT2RP60000390
NT2RP60000590
NT2RP60000720//*Pinus taeda* clone PtaAGP6 putative arabinogalactan protein mRNA, complete cds.//1. 50E-05//165aa//29%//AF101785
NT2RP60000860//*Homo sapiens* mRNA for NICE-5 protein.//6. 30E-192//883 bp//99%//AJ243666
NT2RP60001000//ZINC FINGER PROTEIN 41 (FRAGMENT).//7. 10E-128//366aa//59%//P51814

NT2RP60001090//RING CANAL PROTEIN (KELCH PROTEIN).//6. 40E−79//553aa//33%//Q04652
NT2RP60001230//KINESIN LIGHT CHAIN (KLC).//1. 10E−206//566aa//69%//Q07866
NT2RP60001270//ZINC FINGER PROTEIN ZIC4 (ZINC FINGER PROTEIN OF THE CEREBELLUM 4).//3. 70E−131//264aa//87%//Q61467
NT2RP70000410
NT2RP70000690//MUCIN 1 PRECURSOR (POLYMORPHIC EPITHELIAL MUCIN) (PEM) (PEMT) (EPISIALIN) (TUMOR-ASSOCIATED MUCIN) (CARCINOMA-ASSOCIATED MUCIN) (TUMOR-ASSOCIATED EPITHELIAL MEMBRANE ANTIGEN) (EMA) (H23AG) (PEANUT-REACTIVE URINARY MUCIN) (PUM) (BREAST CARCINOMA-ASSOCIATED ANTIGEN DF3).//2. 00E−26//911aa//25%//P15941
NT2RP70000760//TRANSLATION INITIATION FACTOR EIF-2B EPSILON SUBUNIT (EIF-2B GDP-GTP EXCHANGE FACTOR).//1. 70E−23//66aa//81%//P47823
NT2RP70002380//*Adiantum capillus*-veneris AcExt1 mRNA for Extensin, complete cds.//2. 00E−05//93aa//37%//AB008227
NT2RP70002590//HYPOTHETICAL 32. 0 KDA PROTEIN IN NNF1-STE24 INTERGENIC REGION.//2. 20E−12//251aa//28%//P47153
NT2RP70002710//*Mus musculus* zinc finger protein 276 C2H2 type (Zfp276) mRNA, complete cds.//1. 80E−101//253aa//77%//AF178935
NT2RP70003640
NT2RP70003910
NT2RP70004250//MYOSIN HEAVY CHAIN, NON-MUSCLE TYPE B (CELLULAR MYOSIN HEAVY CHAIN, TYPE B) (NMMHC-B).//4. 30E−08//244aa//24%//P35580
NT2RP70004770//UDP-N-ACETYLGLUCOSAMINE-PEPTIDE N-ACETYLGLUCOSAMINYLTRANSFERASE 110 KDA SUBUNIT (EC 2. 4. 1.-) O-GLCNAC TRANSFERASE P110 SUBUNIT).//1. 00E−22//213aa//32%//P56558
NT2RP70005790
NT2RP70006240//Phosphatidylinositol-4-phosphate 5-kinase homolog T3K9. 2//1. 90E−16//204aa//30%//T02098
NT2RP70008120//HOMEOBOX PROTEIN HOX-B9 (HOX-2. 5).//2. 40E−53//117aa//87%//P20615
NT2RP70009060//*Medicago truncatula* mRNA for 85 p protein (85 p gene).//5. 10E−07//229aa//23%//AJ249679
NT2RP70010800//*Mus musculus* mRNA for MILI (Miwi like), complete cds.//2. 40E−280//614aa//83%//AB032605
NT2RP70011660//PROBABLE CATION-TRANSPORTING ATPASE C10C6. 6 IN CHROMOSOME IV (EC 3. 6. 1.-).//0//1165aa//53%//P90747
NT2RP70012310
NT2RP70013060//U1 SMALL NUCLEAR RIBONUCLEOPROTEIN 70 KDA (U1 SNRNP 70 KDA).//1. 50E−30//241aa//32%//P09406
NT2RP70013350
NT2RP70015910//bK57G9. 1 (novel Kringle and CUB domain protein) [Homo sapiens].//1. 00E−140//247aa//95%//CAB62952
NT2RP70018560//*Mus musculus* polyhomeotic (mPh2) mRNA, complete cds.//5. 00E−232//465aa//91%//U81491
NT2RP70021510
NT2RP70022430//Tax1-binding protein TRX—human.//6. 00E−71//180aa//93%//S68091
NT2RP70023760//M PROTEIN, SEROTYPE 2. 1 PRECURSOR.//2. 20E−13//331aa//25%//P50468
NT2RP70023790//110 KDA ANTIGEN (PK110) (FRAGMENT).//7. 00E−07//162aa//23%//P13813
NT2RP70024490
NT2RP70024500//ZINC FINGER PROTEIN 84 (ZINC FINGER PROTEIN HPF2).//4. 80E−66//312aa//38%//P51523
NT2RP70025540
NT2RP70026190//*Mus musculus* ubiquitin-protein ligase E3-alpha (Ubr1) mRNA, complete cds.//6. 20E−305//597aa//93%//AF061555
NT2RP70028290//Scm-related gene containing four mbt domains [*Mus musculus*].//6. 00E−59//500aa//31%//NP_062333
NT2RP70028410
NT2RP70028750//RESTIN (CYTOPLASMIC LINKER PROTEIN-170 ALPHA-2) (CLIP-170) (REED-STERNBERG INTERMEDIATE FILAMENT ASSOCIATED PROTEIN).//2. 60E−11//87aa//44%//P30622
NT2RP70029060//HEAT SHOCK PROTEIN HSP 90-ALPHA (HSP 86).//0//731aa//99%//P07900
NT2RP70029820//*Homo sapiens* GROS1-L protein mRNA, complete cds.//2. 40E−177//680aa//51%//AF097432
NT2RP70030500
NT2RP70030550
NT2RP70030910
NT2RP70032030//ZINC FINGER PROTEIN 184 (FRAGMENT).//3. 50E−139//366aa//55%//Q99676
NT2RP70033040//YceA protein homolog ybfQ—*Bacillus subtilis*.//1. 00E−35//300aa//33%//C69750
NT2RP70036290//MHC CLASS II TRANSACTIVATOR CIITA.//4. 80E−09//116aa//31%//P33076
NT2RP70036320//Microfilarial sheath protein//5. 00E−06//92aa//35%//S46966
NT2RP70036470
NT2RP70036800//RING CANAL PROTEIN (KELCH PROTEIN).//4. 50E−107//652aa//38%//Q04652
NT2RP70039600
NT2RP70040800//CELL SURFAC GLYCOPROTEIN 1 PRECURSOR (OUTER LAYER PROTEIN B) (S-LAYER PROTEIN 1).//5. 60E−20//307aa//28%//Q06852
NT2RP70042040//ZINC FINGER PROTEIN MLZ-4 (ZINC FINGER PROTEIN 46).//9. 20E−61//254aa//46%//Q03309
NT2RP70042330//HYPOTHETICAL PROTEIN MJ0941.//8. 80E−06//133aa//24%//Q57711
NT2RP70042600//MYOSIN HEAVY CHAIN, NON-MUSCLE TYPE B (CELLULAR MYOSIN HEAVY CHAIN, TYPE B) (NMMHC-B).//4. 50E−21//715aa//21%//P35580
NT2RP70043730
NT2RP70043960//*Mus musculus* mRNA for Fish protein.//0//866aa//88%//AJ007012
NT2RP70045410//*Mus musculus* MGA protein mRNA, complete cds.//2. 70E−265//1040aa//57%//AF205935
NT2RP70046560//PEREGRIN (BR140 PROTEIN).//1. 30E−48//304aa//36%//P55201
NT2RP70046870//VEGETABLE INCOMPATIBILITY PROTEIN HET-E-1.//9. 70E−07//395aa//24%//O00808
NT2RP70047510
NT2RP70047660
NT2RP70047900

NT2RP70049150//*Mus musculus* mRNA for UBE-1c1, UBE-1c2, UBE-1c3, complete cds.//6. 60E−56//209aa//52%//AB030505

NT2RP70049250//VASODILATOR-STIMULATED PHOSPHOPROTEIN (VASP).//1. 90E−08//118aa//33%//P50552

NT2RP70049750

NT2RP70052050//Human transformation-related protein mRNA, 3' end.//2. 20E−12//74aa//52%//L24521

NT2RP70052190

NT2RP70054680

NT2RP70054930

NT2RP70055020//*Homo sapiens* mRNA for paraplegin-like protein.//3. 00E−29//68aa//94%//Y18314

NT2RP70055130//ZINC FINGER PROTEIN 84 (ZINC FINGER PROTEIN HPF2).//7. 00E−130//461aa//46%//P51523

NT2RP70055200//INTEGUMENTARY MUCIN A. 1 PRECURSOR (FIM-A. 1) (PREPROSPASMOLYSIN).//2. 40E−07//120aa//27%//P10667

NT2RP70061620//ZINC FINGER PROTEIN MFG-3.//3. 60E−16//266aa//27%//P16374

NT2RP70061880//GTPASE-ACTIVATING PROTEIN.//1. 70E−08//265aa//21%//P33277

NT2RP70062960//EXCISION REPAIR PROTEIN ERCC-6 (COCKAYNE SYNDROME PROTEIN CSB).//5. 80E−67//185aa//46%//Q03468

NT2RP70063040//*Homo sapiens* MLL septin-like fusion protein (MSF) mRNA, complete cds.//1. 00E−187//348aa//99%//AF123052

NT2RP70063740

NT2RP70064080//*Drosophila melanogaster* F protein (olf186) mRNA, complete cds.//2. 50E−54//203aa//56%//AF188634

NT2RP70064900//ZINC FINGER PROTEIN 84 (ZINC FINGER PROTEIN HPF2).//1. 20E−149//580aa//40%//P51523

NT2RP70065270//LIM-ONLY PROTEIN 6 (TRIPLE LIM DOMAIN PROTEIN 6).//2. 40E−136//341aa//61%//043900

NT2RP70066210

NT2RP70067010

NT2RP70069800

NT2RP70069860//ZINC FINGER PROTEIN 184 (FRAGMENT).//4. 40E−141//566aa//46%//Q99676

NT2RP70071140

NT2RP70071540

NT2RP70071770//*Homo sapiens* multiple membrane spanning receptor TRC8 (TRC8) mRNA, complete cds.//8. 50E−61//599aa//29%//AF064801

NT2RP70072210//*Rattus norvegicus* schlafen-4 (SLFN-4) mRNA, complete cds.//1. 10E−19//244aa//32%//AF168795

NT2RP70072520//Human serine/threonine kinase mRNA, partial cds.//1. 20E−79//154aa//100%//U79240

NT2RP70073590

NT2RP70073810//Sulfonylurea receptor 2A//4. 50E−70//135aa//100%//NP_064694

NT2RP70074060

NT2RP70074220//SYNAPSIN I (BRAIN PROTEIN 4. 1).//2. 20E−05//116aa//34%//P17600

NT2RP70075040

NT2RP70075370//52 KDA RO PROTEIN (SJOGREN SYNDROME TYPE A ANTIGEN (SS-A)) (RO(SS-A)).//1. 20E−97//482aa//42%//P19474

NT2RP70076100//*Homo sapiens* mRNA for putative phospholipase, complete cds.//7. 10E−189//424aa//53%//AB019435

NT2RP70076170

NT2RP70076430//PUTATIVE IMPORTIN BETA-4 SUBUNIT (KARYOPHERIN BETA-4 SUBUNIT).//1. 70E−42//692aa//26%//060100

NT2RP70079250//*Homo sapiens* contactin associated protein (Caspr) mRNA, complete cds.//2. 30E−218//963aa//42%//U87223

NT2RP70079300

NT2RP70079750//*Homo sapiens* BAC526N18 neurexin III gene, partial cds.//5. 00E−177//334aa//100%//AF123462

NT2RP70081330

NT2RP70081370//ATP-BINDING CASSETTE, SUBFAMILY A, MEMBER 1 (ATP-BINDING CASSETTE TRANSPORTER 1) (ATP-BINDING CASSETTE 1).//1. 10E−56//364aa//36%//P41233

NT2RP70081420

NT2RP70081440//DUAL SPECIFICITY MITOGEN-ACTIVATED PROTEIN KINASE KINASE 4 (EC 2. 7. 1.-) (MAP KINASE KINASE 4) (JNK ACTIVATING KINASE 1) (C-JUN N-TERMINAL KINASE KINASE 1) (JNKK) (SAPK/ERK KINASE 1) (SEK1).//7. 20E−77//162aa//91%//P45985

NT2RP70081670//85. 1 KDA PROTEIN IN GREB-FEOA INTERGENIC REGION.//3. 10E−108//568aa//38%//P46837

NT2RP70083150//ENVELOPE GLYCOPROTEIN GP340 (MEMBRANE ANTIGEN) (MA) [CONTAINS: GLYCOPROTEIN GP220].//3. 60E−09//431aa//23%//P03200

NT2RP70084060//Probable hexosyltransferase (EC 2. 4. 1.-) SC2G5. 06//4. 90E−07//127aa//32%//T34839

NT2RP70084410//Polybromo 1 protein—chicken //0//985aa//88%//S60678

NT2RP70084870//TRICHOHYALIN.//9. 20E−16//452aa//21%//P37709

NT2RP70085500//*Mus musculus* rig-1 protein mRNA, complete cds.//0//976aa//86%//AF060570

NT2RP70085570//DNA BINDING PROTEIN URE-B1 (EC 6. 3. 2.-).//3. 40E−23//282aa//27%//P51593

NT2RP70086230

NT2RP70087200//ZINC FINGER PROTEIN 84 (ZINC FINGER PROTEIN HPF2).//1. 20E−164//689aa//42%//P51523

NT2RP70088550//*Rattus norvegicus* membrane-associated guanylate kinase-interacting protein 2 Maguin-2 mRNA, complete cds.//7. 90E−267//434aa//98%//AF102854

NT2RP70090120//CHLORIDE CHANNEL PROTEIN 7 (CLC-7) (FRAGMENT).//0//734aa//99%//P51798

NT2RP70090190//ZINC FINGER PROTEIN 83 (ZINC FINGER PROTEIN HPF1).//3. 60E−146//395aa//61%//P51522

NT2RP70091490//GLUCOSE TRANSPORTER TYPE 2, LIVER.//3. 30E−17//109aa//37%//P14246

NT2RP70091680

NT2RP70092150

NT2RP70092360//BASEMENT MEMBRANE-SPECIFIC HEPARAN SULFATE PROTEOGLYCAN CORE PROTEIN PRECURSOR (HSPG) (PERLECAN) (PLC).//4. 50E−91//1310aa//26%//Q05793

NT2RP70092590

NT2RP70093220//CHLORIDE CHANNEL PROTEIN 5 (CLC-5).//0//746aa//99%//P51795

NT2RP70093630

NT2RP70093700//PUTATIVE SERINE/THREONINE-PROTEIN KINASE PKWA (EC 2. 7. 1.-).//9. 90E−11//241aa//21%//P49695

NT2RP70093730

NT2RP70093940//Exocyst complex protein sec5//0//924aa//93%//T09220

NT2RP70093970
NT2RP70094290
NT2RP70094660
NT2RP70094810//*Drosophila melanogaster* Dispatched (dispatched) mRNA, complete cds.//1. 00E–105//579aa//38%//AF200691
NT2RP70094980//FIBULIN-1, ISOFORM A PRECURSOR.//6. 50E–30//211aa//38%//P23142
NT2RP70095020
NT2RP70095070
NTONG10000330
NTONG10000520//*Rattus norvegicus* mRNA for Kelch related protein 1 (krp1 gene).//2. 00E–118//439aa//49%//AJ293948
NTONG10000980
NTONG10001230//*Mus msuculus* mRNA, partial cds, clone CLFEST42.//6. 10E–07//217aa//25%//D82816
NTONG10001300//*Gallus gallus* kinectin mRNA, complete cds.//1. 30E–15//534aa//22%//U15617
NTONG10001820//*Mus musculus* mammalian inositol hexakisphosphate kinase 1 (1p6k1) mRNA, complete cds.//5. 20E–77//294aa//53%//AF177144
NTONG10002140//SARCALUMENIN PRECURSOR.//3. 50E–204//376aa//97%//P13666
NTONG10002460//CYCLIN-DEPENDENT KINASE INHIBITOR 1C (CYCLIN-DEPENDENT KINASE INHIBITOR P57) (P57KIP2).//1. 10E–16//156aa//40%//P49918
NTONG10002570
NTONG10002640//HYPOTHETICAL 71. 1 KD PROTEIN IN DSK2-CAT8 INTERGENIC REGION.//6. 90E–98//603aa//39%//Q03262
NTONG20002650//Probable transmembrane protein of fission yeast//8. 50E–63//539aa//28%//T39483
NTONG20003340//ZINC FINGER PROTEIN 90 (ZFP-90) (ZINC FINGER PROTEIN NK10).//3. 10E–108//225aa//83%//Q61967
NTONG20003630//CREB-BINDING PROTEIN.//3. 00E–05//160aa//31%//Q92793
NTONG20004920
NTONG20005830
NTONG20008000
NTONG20008780//MAJOR CENTROMERE AUTOANTIGEN B (CENTROMERE PROTEIN B) (CENP-B).//1. 40E–42//330aa//31%//P27790
NTONG20009660//*Mus musculus* N-RAP mRNA, complete cds.//2. 50E–56//393aa//38%//U76618
NTONG20009850
NTONG20011370
NTONG20012220
NTONG20014280
NTONG20015500//ZINC FINGER PROTEIN 135.//1. 40E–128//340aa//64%//P52742
NTONG20016120//Oxystyrol-binding protein homologue 1 [*Mus musculus domesticus*].//3. 00E–43//342aa//37%//AJ278263
OCBBF10000420
OCBBF10000670
OCBBF10000860
OCBBF10000910//SORBIN.//1. 30E–71//145aa//91%//P28220
OCBBF10001040
OCBBF10001180//TUMOR NECROSIS FACTOR, ALPHA-INDUCED PROTEIN 1, ENDOTHELIAL (B12 PROTEIN).//1. 00E–12//124aa//37%//Q13829
OCBBF10001190
OCBBF10001220//RING CANAL PROTEIN (KELCH PROTEIN).//8. 50E–32//274aa//31%//Q04652
OCBBF20000130
OCBBF20001260
OCBBF20002310//PHOSPHOLIPASE A2 INHIBITOR SUBUNIT B PRECURSOR (PLI-B).//3. 50E–27//307aa//29%//093233
OCBBF20002770//EARLY EMBRYOGENESIS ZYG-11 PROTEIN.//1. 40E–46//348aa//34%//P21541
OCBBF20002870
OCBBF20007190//Putative cleavage and polyadenylation specifity factor [*Arabidopsis thaliana*].//1. 00E–142//450aa//53%//AAD12712
OCBBF20008240//THREONYL-TRNA SYNTHETASE, CYTOPLASMIC (EC 6. 1. 1. 3) (THREONINE-TRNA LIGASE) (THRRS).//1. 10E–244//484aa//77%//P26639
OCBBF20009040
OCBBF20009980
OCBBF20010750
OCBBF20011010//ZINC FINGER PROTEIN 91 (ZINC FINGER PROTEIN HTF10) (HPF7).//1. 10E–133//405aa//55%//Q05481
OCBBF20011240//TESTIS SPECIFIC PROTEIN A (ZINC FINGER PROTEIN TSGA).//1. 60E–81//391aa//42%//Q63679
OCBBF20011400//VACUOLAR PROTEIN SORTING-ASSOCIATED PROTEIN VPS8.//3. 30E–17//199aa//23%//P39702
OCBBF20011760//*Mus musculus* actin-binding protein (ENC-1) mRNA, complete cds.//2. 30E–236//527aa//75%//U65079
OCBBF20012100//*Cavia porcellus* phosphatidic acid phosphatase 2a (PAP2a) mRNA, complete cds.//6. 30E–29//285aa//29%//AF088283
OCBBF20013070
OCBBF20014020//*Mus musculus* NSD1 protein mRNA, complete cds.//0//886aa//73%//AF064553
OCBBF20014080//*H. sapiens* mRNA for thioesterase II.//3. 00E–67//163aa//83%//X86032
OCBBF20014940//ubiquitin-protein ligase 1 [*Arabidopsis thaliana*]//2. 00E–15//200aa//30%//AAF36454
OCBBF20015270
OCBBF20015280//MYOSIN HEAVY CHAIN, SMOOTH MUSCLE ISOFORM (SMMHC).//4. 90E–23//415aa//22%//P35748
OCBBF20015860//TRANSCRIPTION ELONGATION FACTOR S-11 (TFIIS).//7. 70E–06//104aa//33%//P49373
OCBBF20017060
PANCR10000210//PROTEIN DISULFIDE ISOMERASE PRECURSOR (PDI) (EC 5. 3. 4. 1) (PROLYL 4-HYDROXYLASE BETA SUBUNIT) (CELLULAR THYROID HORMONE BINDING PROTEIN) (P55).//9. 10E–31//231aa//33%//P05307
PANCR10001850
PEBLM10000290
PEBLM10000340//RNA-BINDING PROTEIN EWS.//1. 80E–284//615aa//83%//Q01844
PEBLM10000680//ACTIN, CYTOPLASMIC TYPE 5.//1. 30E–70//158aa//86%//P53505
PEBLM10001440//Trg//2. 40E–212//385aa//60%//CAA48220
PEBLM10001800
PEBLM20000300
PEBLM20001120//*Homo sapiens* nucleotide-binding site protein 1 mRNA, complete cds.//1. 90E–127//899aa//34%//AF298547
PEBLM20001260
PEBLM20001470

PEBLM20002130//*Mus musculus* genes for integrin aM290, hapsin, partial and complete cds.//8. 20E-44//246aa//47%//AB036930
PEBLM20002480//ZINC FINGER PROTEIN 157.//8. 70E-71//210aa//47%//P51786
PEBLM20002700//*Homo sapiens* tissue-type bone marrow zinc finger protein 4 mRNA, complete cds.//6. 70E-237//537aa//80%//AF070651
PEBLM20003080//ZINC FINGER PROTEIN 135.//2. 40E-133//335aa//65%//P52742
PEBLM20003950//ZINC FINGER PROTEIN 165.//3. 20E-35//143aa//59%//P49910
PEBLM20004790//PROTO-ONCOGENE TYROSINE-PROTEIN KINASE FYN (EC 2. 7. 1. 112) (P59-FYN).//4. 70E-264//410aa//95%//P39688
PLACE50000370//*Homo sapiens* mRNA for hVPS11, complete cds.//1. 80E-149//281aa//98%//AB027508
PLACE50000580//PUTATIVE IMPORTIN BETA-4 SUBUNIT (KARYOPHERIN BETA-4 SUBUNIT).//9. 60E-76//937aa//27%//O60100
PLACE50000670
PLACE50000680//C4B-BINDING PROTEIN PRECURSOR (C4BP).//5. 10E-09//136aa//30%//P08607
PLACE50000800//Human non-lens beta gamma-crystallin like protein (AIM1) mRNA, partial cds.//0//840aa//99%//U83115
PLACE50001050//*Mus musculus* mRNA for heparan sulfate 6-sulfotransferase 2, complete cds.//6. 10E-236//300aa//89%//AB024565
PLACE50001130//GLUCOAMYLASE S1/S2 PRECURSOR (EC 3. 2. 1. 3) (GLUCAN 1,4-ALPHA-GLUCOSIDASE) (1,4-ALPHA-D-GLUCAN GLUCOHYDROLASE).//2. 20E-23//729aa//24%//P08640
PLACE50001530
PLACE50001700//DNAK PROTEIN (HEAT SHOCK PROTEIN 70) (HSP70).//3. 00E-05//108aa//30%//Q56235
PLACE60000440
PLACE60000700
PLACE60000800
PLACE60001370
PLACE60002050//TRANSCRIPTIONAL REPRESSOR PROTEIN YY1 (YIN AND YANG 1) (YY-1) (DELTA TRANSCRIPTION FACTOR) (NF-E1).//6. 00E-73//212aa//66%//P25490
PLACE60002630
PLACE60003710
PLACE60003790//PUTATIVE PRE-MRNA SPLICING FACTOR RNA HELICASE (DEAH BOX PROTEIN 15) (ATP-DEPENDENT RNA HELICASE #46).//5. 30E-104//191aa//99%//O43143
PLACE60004240
PLACE60004290
PLACE60005230
PLACE60005500
PLACE60005550//Human (c-myb) gene, complete primary cds, and five complete alternatively spliced cds.//4. 60E-20//71aa//66%//U22376
PLACE60009530
PLACE60012810//Probable acyl-CoA synthetase (EC 6. 2. 1.-)—Mycobacterium tuberculosis (strain H37RV)//3. 00E-11//600aa//24%//C70669
PLACE60012940
PLACE60014430//*Homo sapiens* mRNA for MOCS1A & MOCS1B proteins, complete CDSs.//1. 60E-146//283aa//98%//AJ224328
PLACE60018860//ADENYLATE CYCLASE, TYPE IV (EC 4. 6. 1. 1) (ATP PYROPHOSPHATE-LYASE) (ADENYLYL CYCLASE).//1. 30E-244//504aa//90%//P26770
PLACE60019230
PLACE60019250
PLACE60020160
PLACE60020840//CYTOCHROME B561 (CYTOCHROME B-561).//1. 00E-45//211aa//47%//Q95245
PLACE60021020
PLACE60021510//ZINC FINGER PROTEIN 84 (ZINC FINGER PROTEIN HPF2).//5. 00E-140//351aa//61%//P51523
PLACE60024190//TRICHOHYALIN.//1. 40E-09//299aa//24%//P37709
PLACE60026680//*Homo sapiens* Arg/AbI-interacting protein ArgBP2b (ArgBP2b) mRNA, partial cds.//1. 00E-254//484aa//96%//AF049885
PLACE60026920
PLACE60026990//Human PMS2 related (hPMSR6) mRNA, complete cds.//5. 70E-42//112aa//75%//U38980
PLACE60029490
PLACE60030380//ZINC FINGER PROTEIN 84 (ZINC FINGER PROTEIN HPF2).//3. 60E-34//335aa//30%//P51523
PLACE60030940
PLACE60031090
PLACE60032040
PLACE60033720
PLACE60033990//SPIDROIN 1 (DRAGLINE SILK FIBROIN 1) (FRAGMENT).//1. 40E-08//234aa//27%//P19837
PLACE60037050
PLACE60037400
PLACE60037450
PLACE60038500//*Homo sapiens* mitochondrial solute carrier mRNA, complete cds.//5. 10E-65//171aa//70%//AF155660
PLACE60040050
PLACE60043120
PLACE60043360
PLACE60043960
PLACE60043970//*Takifugu rubripes* retinitis pigmentosa GTPase regulator-like protein gene, partial cds.//2. 60E-14//329aa//21%//AF286475
PLACE60044540//GLUCOAMYLASE S1/S2 PRECURSOR (EC 3. 2. 1. 3) (GLUCAN 1,4-ALPHA-GLUCOSIDASE) (1,4-ALPHA-D-GLUCAN GLUCOHYDROLASE).//1. 90E-46//865aa//26%//P08640
PLACE60044640//Human placenta (Diff48) mRNA, complete cds.//2. 60E-88//414aa//45%//U49187
PLACE60044910
PLACE60046630
PLACE60046870
PLACE60047380
PLACE60049310
PLACE60049930
PLACE60050290
PROST10001520
PROST10001670//SYNAPSIN I (BRAIN PROTEIN 4. 1).//2. 20E-07//239aa//28%//P17600
PROST10002200
PROST10002460
PROST10002720//*Homo sapiens* mRNA for calsyntenin-2 (CS2 gene).//7. 00E-23//153aa//42%//AJ278018

PROST10003430//Numb-binding protein LNXp80//0//732aa//87%//T09457
PROST10005260
PROST10005360//*Homo sapiens* contactin associated protein (Caspr) mRNA, complete cds.//1. 30E–152//719aa//38%//U87223
PROST10005640
PROST20000360
PROST20000530//60S RIBOSOMAL PROTEIN L13A (23 KDA HIGHLY BASIC PROTEIN).//2. 00E–33//73aa//95%//P40429
PROST20001760//RD PROTEIN (WL623).//7. 30E–12//104aa//41%//P19426
PROST20002060
PROST20002670
PROST20002730//H4(D10S170) PROTEIN.//2. 60E–63//118aa//98%//Q16204
PROST20002740
PROST20003250//*Homo sapiens* DAZ associated protein 1 (DAZAP1) mRNA, complete cds.//2. 50E–150//264aa//98%//AF181719
PROST20004630
PROST20017390
PROST20017960
PROST20018230//TRANSCRIPTION FACTOR SP1.//4. 60E–59//287aa//42%//Q01714
PROST20018990//Human Rar protein mRNA, complete cds.//1. 20E–127//278aa//88%//U05227
PROST20019980
PROST20021620
PROST20023380//Cca3 protein//5. 20E–68//142aa//94%//T31081
PROST20025910
PROST20026820//DENTIN MATRIX ACIDIC PHOSPHOPROTEIN 1 PRECURSOR (DENTIN MATRIX PROTEIN-1) (DMP-1) (AG1).//6. 90E–05//255aa//27%//055188
PROST20028420
PROST20029600//Human butyrophilin (BTF1) mRNA, complete cds.//2. 00E–61//144aa//87%//U90543
PROST20031020
PROST20031170//DNA BINDING PROTEIN URE-B1 (EC 6. 3. 2.-).//1. 70E–23//282aa//27%//P51593
PROST20032100
PROST20032320//BETA-GLUCURONIDASE PRECURSOR (EC 3. 2. 1. 31) (BETA-G1).//1. 20E–18//46aa//91%//P08236
PROST20033020
PROST20033030
PROST20033380//KINESIN LIGHT CHAIN (KLC).//7. 70E–08//146aa//27%//P46824
PROST20033400//SERINE/THREONINE-PROTEIN KINASE 9 (EC 2. 7. 1.-).//1. 80E–25//55aa//100%//076039
PROST20034720//IMMEDIATE-EARLY PROTEIN.//7. 80E–11//180aa//24%//Q01042
PROST20037320
PROST20039220
PROST20043320//*Homo sapiens* mRNA for BAP2-beta protein, complete cds.//3. 70E–227//431aa//99%//AB015020
PROST20044160//TROPOMYOSIN 5, CYTOSKELETAL TYPE.//7. 80E–48//100aa//97%//P21107
PROST20044810
PROST20051210//PROBABLE PROTEIN PHOSPHATASE 2C T23F11. 1 (EC 3. 1. 3. 16) (PP2C).//7. 00E–16//74aa//41%//P49596
PROST20051430
PROST20054260
PROST20056040
PROST20058800
PROST20059190//Human breast cancer, estrogen regulated LIV-1 protein (LIV-1) mRNA, partial cds.//1. 50E–28//109aa//55%//U41060
PROST20059430
PROST20061960
PROST20062600//SPLICING FACTOR, ARGININE/SERINE-RICH 4 (PRE-MRNA SPLICING FACTOR SRP75).//2. 20E–07//269aa//22%//Q08170
PROST20064500//N-HYDROXYARYLAMINE SULFOTRANSFERASE (EC 2. 8. 2.-) (HAST-I).//9. 10E–38//102aa//70%//P50237
PROST20067370//*H. sapiens* mRNA for XIAP associated factor-1.//2. 40E–122//223aa//99%//X99699
PROST20069880//*Mus musculus* DXImx48e protein (DXImx48e) mRNA, complete cds.//9. 6e–316//750aa//79%//AF229644
PROST20072370
PROST20072890//TUMOR NECROSIS FACTOR, ALPHA-INDUCED PROTEIN 1, ENDOTHELIAL (B12 PROTEIN).//1. 50E–117//314aa//70%//Q13829
PROST20073170//*Rattus norvegicus* zinc finger protein RIN ZF mRNA, complete cds.//1. 80E–268//559aa//87%//AF091457
PROST20073890//VASCULAR ENDOTHELIAL GROWTH FACTOR PRECURSOR (VEGF) (VASCULAR PERMEABILITY FACTOR) (VPF).//5. 30E–33//63aa//98%//P15692
PROST20079740//ANTER-SPECIFIC PROLINE-RICH PROTEIN APG (PROTEIN CEX) (FRAGMENT).//4. 10E–09//97aa//36%//P40603
PROST20085160//TROPOMYOSIN, CYTOSKELETAL TYPE (TM30-NM).//2. 10E–93//220aa//87%//P12324
PROST20094830
PUAEN10000570
PUAEN10000810
PUAEN10001610//GENERAL NEGATIVE REGULATOR OF TRANSCRIPTION SUBUNIT 1.//2. 10E–68//448aa//32%//P25655
PUAEN10003220
SALGL10000050
SALGL10000470//NG36 [*Homo sappiens*]//3. 00E–53//184aa//96%//AAD21811
SALGL10000650//POLYHOMEOTIC-PROXIMAL CHROMATIN PROTEIN.//4. 60E–08//71aa//43%//P39769
SALGL10001570//APOLIPOPROTEIN L PRECURSOR (APO-L).//5. 10E–99//338aa//61%//014791
SKMUS10000140//Polyubiquitin 9—human.//2. 10E–199//280aa//96%//M26880
SKMUS10000220//NUCLEAR PORE PROTEIN SEH1 HOMOLOG.//2. 00E–58//346aa//39%//Q10099
SKMUS10000640//*Mus musculus* RING-finger protein MURF mRNA, complete cds.//4. 10E–11//348aa//60%//AF294790
SKMUS10001040//*Homo sapiens* mRNA for HEXIM1 protein, complete cds.//2. 40E–49//256aa//47%//AB021179
SKMUS10001180//*Homo sapiens* t(3:5)(q25. 1:p34) fusion gene NPM-MLF1 mRNA, complete cds.//3. 60E–126//258aa//94%//L49054
SKMUS10001240
SKMUS10001290//ISOPENTENYL-DIPHOSPHATE DELTA-ISOMERASE (EC 5. 3. 3. 2) (IPP ISOMERASE)

(ISOPENTENYL PYROPHOSPHATE ISOMERASE).//4. 10E−81//227aa//64%//Q13907
SKMUS10001770//PROTEIN-L-ISOASPARTATE O-METHYLTRANSFERASE (EC 2. 1. 1. 77) (PROTEIN-BETA-ASPARTATE METHYLTRANSFERASE) (PIMT) (PROTEIN L-ISOASPARTYL METHYLTRANSFERASE) (L-ISOASPARTYL PROTEIN CARBOXYL METHYLTRANSFERASE).//2. 50E−18//213aa//29%//026915
SKMUS20000740//*Homo sapiens* methyltransferase C0Q3 (C0Q3) mRNA, complete cds.//8. 50E−166//309aa//99%//AF193016
SKMUS20001170//*Homo sapiens* MAGEF1 (MAGEF1) mRNA, complete cds.//1. 50E−74//305aa//50%//AF295378
SKMUS20002710
SKMUS20003430
SKMUS20003650//Human (p23) mRNA, complete cds.//7. 00E−20//110aa//39%//L24804
SKMUS20003900//*Homo sapiens* 38 kDa Mov34 homolog mRNA, complete cds.//1. 20E−152//286aa//99%//U70734
SKMUS20004580//*Mus musculus* N-RAP mRNA, complete cds.//4. 50E−160//591aa//56%//U76618
SKMUS20004670
SKMUS20004680
SKMUS20007240//*Homo sapiens* mRNA for 2-hydroxyphytanoyl-CoA lyase.//2. 60E−148//318aa//88%//AJ131753
SKMUS20007740//BALBIANI RING PROTEIN 1 (GIANT SECRETORY PROTEIN I-A) (GSP-IA) (FRAGMENT).//1. 30E−08//138aa//26%//P02849
SKMUS20008470
SKMUS20008630//PROBABLE ASPARAGINYL-TRNA SYNTHETASE (EC 6. 1. 1. 22) (ASPARAGINE-TRNA LIGASE) (ASNRS).//1. 10E−103//445aa//46%//P52276
SKMUS20009020//BR01 PROTEIN.//2. 30E−08//232aa//26%//P48582
SKMUS20009330//RNA polymerase III subunit [*Homo sapiens*]//1. 80E−44//216aa//47%//U93868
SKMUS20009450
SKMUS20009540//*Homo sapiens* F-box protein Fbx25 (FBX25) mRNA, partial cds.//4. 20E−93//263aa//64%//AF174605
SKMUS20010080//*Mus musculus* mRNA for a skeletal muscle and cardiac protein.//1. 00E−75//178aa//87%//AJ011118
SKMUS20011290//NAD-DEPENDENT METHANOL DEHYDROGENASE (EC 1. 1. 1. 244) (MEDH).//3. 70E−45//195aa//32%//P31005
SKMUS20011470//*Mus musculus* RP42 mRNA, complete cds.//1. 30E−32//186aa//36%//AF198092
SKMUS20013640
SKMUS20014920//Zinc finger protein//4. 40E−05//153aa//24%//T37771
SKMUS20015010
SKMUS20015430//*Homo sapiens* HDCMC29P mRNA, partial cds.//3. 50E−128//248aa//97%//AF068295
SKMUS20016080
SKMUS20016310
SKMUS20016340//HIGH MOBILITY GROUP PROTEIN HMG2 (HMG-2).//6. 00E−11//170aa//25%//P26583
SKMUS20016620//*Oryctolagus cuniculus* CARP mRNA, complete cds.//2. 70E−43//196aa//51%//AF131883
SKMUS20016680//Neuron-specific signal trunduction protein Stac//8. 30E−33//218aa//38%//NP_058549
SKMUS20016710
SKNMC10000070
SKNMC10000100
SKNMC10000190
SKNMC10000290
SKNMC10001100
SKNMC10001590
SKNMC10001680
SKNMC10002290
SKNMC10002510//*Homo sapiens* MT-ABC transporter (MTABC) mRNA, complete cds.//0//672aa//93%//AF076775
SKNMC10002640
SKNMC20000650//ZINC FINGER PROTEIN 136.//7. 20E−05//311aa//23%//P52737
SKNMC20000970//*M. musculus* mRNA for protein Htf9C.//9. 80E−220//552aa//75%//X56044
SKNMC20002240//ZINC FINGER PROTEIN 228.//1. 80E−68//226aa//53%//Q9UJU3
SKNMC20003050
SKNMC20003220//MAJOR CENTROMERE AUTOANTIGEN B (CENTROMERE PROTEIN B) (CENP-B).//3. 70E−10//153aa//32%//P07199
SKNMC20003560//*Mus musculus* Max-interacting transcriptional repressor (Mad3) mRNA, complete cds.//1. 90E−72//168aa//86%//U32394
SKNMC20005930
SKNMC20006120
SKNMC20010570
SKNMC20011130//*Rattus norvegicus* golgi peripheral membrane protein p65 (GRASP65) mRNA, complete cds.//6. 90E−90//244aa//66%//AF015264
SKNMC20015030//P-SELECTIN GLYCOPROTEIN LIGAND 1 PRECURSOR (PSGL-1) (SELECTIN P LIGAND).//3. 60E−11//152aa//32%//Q62170
SKNMC20015550
SKNMC20015960//*Homo sapiens* mRNA for ANKHZN, complete cds.//0//1046aa//95%//AB037360
SKNSH10000860
SKNSH10001740//ORNITHINE DECARBOXYLASE (EC 4. 1. 1. 17) (ODC).//9. 00E−102//352aa//53%//P00860
SKNSH10003010//*Homo sapiens* DRC3 mRNA, complete cds.//3. 00E−154//305aa//91%//AF282167
SKNSH10003080
SKNSH20001510
SKNSH20001630
SKNSH20003470//CYTOCHROME B2 PRECURSOR (EC 1. 1. 2. 3) (L-LACTATE DEHYDROGENASE (CYTOCHROME)) (L-LACTATE FERRICYTOCHROME C OXIDOREDUCTASE) (L-LCR).//2. 60E−07//107aa//32%//P00175
SMINT10000160//2-HYDROXYACYLSPHINGOSINE 1-BETA-GALACTOSYLTRANSFERASE PRECURSOR (EC 2. 4. 1. 45) (UDP-GALACTOSE-CERAMIDE GALACTOSYLTRANSFERASE) (CERAMIDE UDP-GALACTOSYLTRANSFERASE) (CEREBROSIDE SYNTHASE).//3. 80E−71//492aa//33%//Q64676
SMINT10000390
SMINT10000420//ATP-BINDING CASSETTE, SUBFAMILY A, MEMBER 3 (ATP-BINDING CASSETTE TRANSPORTER 3) (ATP-BINDING CASSETTE 3) (ABC-C TRANSPORTER).//2. 70E−92//662aa//34%//Q99758
SMINT10000540
SMINT10000570//*Homo sapiens* leucocyte immunoglobulin-like receptor-8 (LIR-8) mRNA, complete cds.//5. 30E−212//481aa//84%//AF025534

SMINT10000710
SMINT10001000//PAIRED MESODERM HOMEOBOX PROTEIN 2B (PAIRED-LIKE HOMEOBOX 2B) (PHOX2B HOMEODOMAIN PROTEIN) (NEUROBLASTOMA PHOX) (NBPHOX).//1. 60E–05//87aa//39%//Q99453
SMINT10001030//*Homo sapiens* ankyrin repeat-containing protein ASB-2 mRNA, complete cds.//1. 20E–292//546aa//99%//AF159164
SMINT10001180
SMINT20000180
SMINT20000400
SMINT20001450//*Halocynthia roretzi* mRNA for HrPET-3, complete cds.//2. 30E–20//125aa//40%//AB029335
SMINT20002270
SMINT20002390
SMINT20002770//BUTYROPHILIN PRECURSOR (BT).//3. 20E–51//269aa//41%//P18892
SMINT20003960//A kinase anchor protein AKAP-KL isoform 2//5. 00E–254//738aa//70%//T09226
SMINT20004000//*Homo sapiens* FRG1 mRNA, complete cds.//7. 00E–52//116aa//90%//L76159
SMINT20005450//*Mus musculus* Zfp228 (Znf228) mRNA, complete cds.//1. 20E–31//125aa//49%//AF282919
SMINT20005580
SPLEN10000490
SPLEN10000910//*Homo sapiens* HRIHFB2007 mRNA, partial cds.//5. 20E–95//199aa//90%//AB015330
SPLEN10001430//HIGH MOBILITY GROUP PROTEIN HMG1 (HMG-1).//3. 00E–78//147aa//100%//P09429
SPLEN20000200//Human (c-myb) gene, complete primary cds, and five complete alternatively spliced cds.//3. 10E–11//64aa//57%//U22376
SPLEN20000470
SPLEN20000720//ZINC FINGER PROTEIN CKR1.//3. 10E–37//235aa//37%//P30373
SPLEN20001340//CARBOXYPEPTIDASE S PRECURSOR (EC 3. 4. 17. 4) (YSCS) (GLY-X CARBOXYPEPTIDASE).//3. 30E–29//250aa//37%//P27614
SPLEN20001970//SPLICING FACTOR, ARGININE/SERINE-RICH 4 (PRE-MRNA SPLICING FACTOR SRP75).//2. 70E–14//243aa//28%//Q08170
SPLEN20002420
SPLEN20002430
SPLEN20002670//*Rattus norvegicus* TGF-beta resistance-associated protein (TRAG) mRNA, complete cds.//0//559aa//84%//AF305813
SPLEN20002700
SPLEN20003100
SPLEN20003570//*Mus musculus* RaIGDS-like protein 3 mRNA, complete cds.//8. 30E–191//453aa//81%//AF237669
SPLEN20004430
SPLEN20004960
SPLEN20005410
STOMA10000470
STOMA10000520
STOMA10001170
STOMA10001330
STOMA10001860//CYTOSOLIC ACYL COENZYME A THIOESTER HYDROLASE (EC 3. 1. 2. 2) (LONG CHAIN ACYL-COA THIOESTER HYDROLASE) (CTE-II).//2. 70E–173//328aa//99%//O00154
STOMA20000320
STOMA20000880//IG LAMBDA CHAIN C REGIONS.//1. 50E–51//105aa//96%//P01842
STOMA20001210//*Fugu rubripes* CCBL1 gene, exons 1 to 12.//1. 90E–127//415aa//55%//Y17462
STOMA20001880
STOMA20002570
STOMA20002890
STOMA20003960//LIM-ONLY PROTEIN 6 (TRIPLE LIM DOMAIN PROTEIN 6).//3. 60E–59//352aa//39%//043900
STOMA20004780
STOMA20004820//1-phosphatidylinositol-4,5-bisphosphate phosphodiesterase (EC 3. 1. 4. 11) delta-2//6. 90E–148//325aa//84%//S14113
SYNOV10001280//*Homo sapiens* colon cancer-associated protein Mic1 (MIC1) mRNA, complete cds.//1. 1e–316//609aa//97%//AF143536
SYNOV10001640
SYNOV20001770
SYNOV20002910//Arabinogalactan-like protein//2. 90E–07//124aa//31%//S52994
SYNOV20008200//*Trichoplusia ni* transposon IFP2.//4. 10E–13//254aa//27%//J04364
SYNOV20010140//*Mus musculus* Zfp228 (Znf228) mRNA, complete cds.//2. 50E–31//125aa//49%//AF282919
SYNOV20011440
SYNOV20013740//ZINC FINGER PROTEIN 134.//1. 90E–108//332aa//53%//P52741
SYNOV20014510//MYOCYTE-SPECIFIC ENHANCER FACTOR 2B (SERUM RESPONSE FACTOR-LIKE PROTEIN 2) (XMEF2) (RSRFR2).//6. 40E–140//302aa//88%//Q02080
SYNOV20014570
SYNOV20016480//THYMIDINE PHOSPHORYLASE PRECURSOR (EC 2. 4. 2. 4) (TDRPASE) (TP) (PLATELET-DERIVED ENDOTHELIAL CELL GROWTH FACTOR) (PD-ECGF) (GLIOSTATIN).//2. 80E–35//69aa//100%//P19971
TESTI10000230
TESTI10000250//*M.musculus* mRNA for testis-specific protein, DDC8.//2. 60E–68//462aa//42%//Y09878
TESTI10000420//PARAMYOSIN (ANTIGEN SJ97).//2. 50E–08//367aa//23%//Q05870
TESTI10000510//CYTADHERENCE HIGH MOLECULAR WEIGHT PROTEIN 2 (CYTADHERENCE ACCESSORY PROTEIN 2).//4. 00E–13//648aa//22%//P75471
TESTI10000550//HOMEOBOX PROTEIN SIX1 (FRAGMENT).//8. 90E–11//199aa//30%//Q62231
TESTI10000640//*Fugu rubripes* sex comb on midleg-like 2 protein (SCML2) gene, complete cds.//2. 20E–140//513aa//49%//AF146688
TESTI10000700//*Rattus norvegicus* deubiquitinating enzyme ubp69 (ubp69) mRNA, complete cds.//7. 00E–297//618aa//88%//AF106659
TESTI10000960
TESTI10001250
TESTI10001270//POLYCYSTIN PRECURSOR (AUTOSOMAL DOMINANT POLYCYSTIC KIDNEY DISEASE PROTEIN 1).//3. 60E–11//161aa//33%//P98161
TESTI10001310//*Homo sapiens* TCP11 (TCP11) mRNA, complete cds.//1. 90E–223//425aa//100%//AF269223
TESTI10001380//NEUROENDOCRINE CONVERTASE 3 PRECURSOR (EC 3. 4. 21. 61) (NEC 3) (PC4) (PROHORMONE CONVERTASE 3) (KEX2-LIKE ENDOPROTEASE 3).//1. 10E–140//303aa//85%//P29121
TESTI10001630

TESTI10001680//PROTEIN PHOSPHATASES PP1 REGULATORY SUBUNIT SDS22.//4. 30E−14//158aa//35%//P36047
TESTI10001790
TESTI10001910//*Homo sapiens* 88-kDa Golgi protein (GM88) mRNA, complete cds.//8. 70E−77//274aa//59%//AF204231
TESTI20000180
TESTI20000440//TRICHOHYALIN.//3. 00E−16//476aa//26%//P22793
TESTI20001200//*Homo sapiens* mRNA for zinc finger 3 (ZF3 gene).//6. 90E−13//108aa//40%//X60153
TESTI20001540//PUTATIVE SERINE/THREONINE-PROTEIN KINASE D1044. 3 IN CHROMOSOME III (EC 2. 7. 1.-).//1. 30E−32//103aa//48%//P41951
TESTI20001770//INTER-ALPHA-TRYPSIN INHIBITOR HEAVY CHAIN H3 PRECURSOR (ITI HEAVY CHAIN H3) (SERUM-DERIVED HYALURONAN-ASSOCIATED PROTEIN) (SHAP).//5. 10E−05//157aa//22%//Q06033
TESTI20001790
TESTI20001840//SIT4-ASSOCIATING PROTEIN SAP185.//7. 90E−08//109aa//33%//P40856
TESTI20002070//NIFU-LIKE PROTEIN.//3. 60E−43//105aa//80%//Q9ZD61
TESTI20002080//*Homo sapiens* mRNA for Gab2, complete cds.//7. 60E−62//222aa//60%//AB018413
TESTI20002380
TESTI20002530//*Homo sapiens* A1U mRNA, complete cds.//6. 60E−17//220aa//31%//AF188240
TESTI20003560//TUBULIN ALPHA-3/ALPHA-7 CHAIN.//2. 00E−40//119aa//73%//P05214
TESTI20003720
TESTI20004350//CALDESMON (CDM).//1. 20E−09//180aa//23%//P12957
TESTI20004620
TESTI20005200
TESTI20005910//ADENYLATE KINASE, CHLOROPLAST (EC 2. 7. 4. 3) (ATP-AMP TRANSPHOSPHORYLASE).//3. 60E−34//209aa//37%//P43188
TESTI20006000//RESTIN (CYTOPLASMIC LINKER PROTEIN-170 ALPHA-2) (CLIP-170) (REED-STERNBERG INTERMEDIATE FILAMENT ASSOCIATED PROTEIN).//6. 80E−21//196aa//32%//P30622
TESTI20006270
TESTI20006710
TESTI20006950//KINESIN HEAVY CHAIN.//7. 80E−07//391aa//22%//P21613
TESTI20006990//KINESIN-LIKE PROTEIN KIF2 (KINESIN-2) (HK2).//2. 00E−184//539aa//63%//O00139
TESTI20007070//DOUBLESEX PROTEIN, MALE-SPECIFIC.//3. 00E−13//163aa//31 %//P23023
TESTI20007620//DRA PROTEIN (DOWN-REGULATED IN ADENOMA).//1. 60E−09//88aa//38%//P40879
TESTI20007840//PUTATIVE IMPORTIN BETA-4 SUBUNIT (KARYOPHERIN BETA-4 SUBUNIT).//6. 00E−89//1092aa//26%//O60100
TESTI20008190
TESTI20008300
TESTI20008490//MYOSIN HEAVY CHAIN, CLONE 203 (FRAGMENT).//4. 90E−09//331aa//24%//P39922
TESTI20008830//MYOSIN-BINDING PROTEIN C, SLOW-TYPE (SLOW MYBP-C) (C-PROTEIN, SKELETAL MUSCLE SLOW-ISOFORM).//4. 20E−88//162aa//100%//Q00872
TESTI20009090
TESTI20009510
TESTI20009700
TESTI20010080
TESTI20010490//HYPOTHETICAL ZINC FINGER PROTEIN KIAA0961.//2. 70E−155//504aa//56%//Q9Y2G7
TESTI20010820
TESTI20011340
TESTI20011410//*Rattus norvegicus* actin-filament binding protein Frabin mRNA, complete cds.//0//766aa//83%//AF038388
TESTI20011800//TRICHOHYALIN.//5. 80E−07//322aa//22%//Q07283
TESTI20012370//RING CANAL PROTEIN (KELCH PROTEIN).//1. 60E−38//438aa//26%//Q04652
TESTI20012690//DIHYDROLIPOAMIDE ACETYL-TRANSFERASE COMPONENT OF PYRUVATE DEHYDROGENASE COMPLEX, MITOCHONDRIAL PRECURSOR (EC 2. 3. 1. 12) (E2) (PDC-E2) (70 KDA MITOCHONDRIAL AUTOANTIGEN OF PRIMARY BILIARY CIRRHOSIS) (PBC) (M2 ANTIGEN COMPLEX 70 KDA SUBUNIT).//3. 40E−308//575aa//99%//P10515
TESTI20013060
TESTI20013300//*Homo sapiens* NY-REN-60 antigen mRNA, partial cds.//1. 10E−172//315aa//99%//AF155116
TESTI20013450//*M. musculus* Tenr mRNA for RNA binding protein.//3. 00E−273//576aa//88%//X84693
TESTI20013520
TESTI20014120//TRICHOHYALIN.//1. 40E−28//370aa//27%//P37709
TESTI20014200//*D. melanogaster* mRNA for putative organic cation transporter, 2064 bp.//4. 20E−54//357aa//33%//Y12400
TESTI20015110//MYOSIN II HEAVY CHAIN, NON MUSCLE.//3. 50E−07//255aa//24%//P08799
TESTI20015120//TOM1 (target of myb 1)//1. 00E−57//245aa//56%//NP_005479
TESTI20015560//ZINC FINGER PROTEIN 151 (MYC-INTERACTING ZINC FINGER PROTEIN) (MIZ-1 PROTEIN).//9. 50E−16//278aa//28%//Q13105
TESTI20015930
TESTI20016210
TESTI20016610//DYNEIN BETA CHAIN, FLAGELLAR OUTER ARM.//1. 10E−17//432aa//25%//Q39565
TESTI20016650//IMMEDIATE-EARLY PROTEIN.//9. 50E−06//111aa//28%//Q01042
TESTI20016710
TESTI20017580
TESTI20017660
TESTI20017920
TESTI20018150//GASTRULA ZINC FINGER PROTEIN XLCGF7. 1 (FRAGMENT).//7. 20E−13//98aa//37%//P18735
TESTI20018260
TESTI20018270//TRANSKETOLASE (EC 2. 2. 1. 1) (TK) (P68).//6. 90E−230//614aa//67%//P40142
TESTI20018290
TESTI20018520//*Homo sapiens* contactin associated protein (Caspr) mRNA, complete cds.//5. 40E−167//724aa//40%//U87223
TESTI20018620
TESTI20018690//*Xenopus laevis* bicaudal-C (Bic-C) mRNA, complete cds.//1. 20E−08//189aa//30%//AF224746
TESTI20018790//ZINC FINGER PROTEIN 157.//8. 70E−104//443aa//45%//P51786
TESTI20018980

TESTI20019500
TESTI20019680
TESTI20019910
TESTI20020020
TESTI20020480
TESTI20020570//Human actin-like peptide mRNA, partial cds.//6. 10E−140//307aa//88%//U20582
TESTI20020810//HYPOTHETICAL 80. 0 KDA PROTEIN IN POL1-RAS2 INTERGENIC REGION.//5. 30E−40//235aa//35%//P50944
TESTI20020900
TESTI20021050//MICRONUCLEAR LINKER HISTONE POLYPROTEIN (MIC LH) [CONTAINS: LINKER HISTONE PROTEINS ALPHA, BETA, DELTA AND GAMMA].//3. 90E−11//365aa//24%//P40631
TESTI20021490//ZINC FINGER PROTEIN 131 (FRAGMENT).//5. 30E−191//347aa//99%//P52739
TESTI20022230//*Chlamydomonas reinhardtii* strain 1132D-flagellar protofilament ribbon protein (RIB43a) mRNA, complete cds.//7. 70E−12//137aa//31%//AF196576
TESTI20022450
TESTI20022510
TESTI20022560//GUANYLATE KINASE (EC 2. 7. 4. 8) (GMP KINASE).//2. 20E−20//188aa//31%//Q64520
TESTI20022640
TESTI20022940//MOB2 PROTEIN (MPS1 BINDER 2).//4. 80E−16//133aa//31%//P43563
TESTI20023610
TESTI20023690
TESTI20024150
TESTI20024230//PISTIL-SPECIFIC EXTENSIN-LIKE PROTEIN PRECURSOR (PELP).//8. 40E−15//155aa//34%//Q03211
TESTI20024610//TRICHOHYALIN.//3. 60E−13//423aa//23%//P37709
TESTI20024650//FIBROIN HEAVY CHAIN PRECURSOR (FIB-H) (FRAGMENTS).//4. 70E−06//142aa//33%//P05790
TESTI20024670
TESTI20024980//*Danio rerio* p55-related MAGUK protein DLG3 (dIg3) mRNA, complete cds.//2. 00E−221//532aa//75%//AF124435
TESTI20025160//MELANOMA-ASSOCIATED ANTIGEN B1 (MAGE-B1 ANTIGEN) (MAGE-XP ANTIGEN) (DAM10).//1. 40E−89//349aa//54%//P43366
TESTI20025440
TESTI20025800
TESTI20026320
TESTI20026760//ZINC-BINDING PROTEIN A33.//1. 60E−38//235aa//37%//Q02084
TESTI20026980
TESTI20027000
TESTI20027070//PLASMA-CELL MEMBRANE GLYCOPROTEIN PC-1 [INCLUDES: ALKALINE PHOSPHODIESTERASE I (EC 3. 1. 4. 1); NUCLEOTIDE PYROPHOSPHATASE (EC 3. 6. 1. 9) (NPPASE)].//1. 50E−50//406aa//33%//P22413
TESTI20027290//*Homo sapiens* mRNA for oligophrenin 1.//2. 50E−56//393aa//38%//AJ001189
TESTI20027890//ZINC FINGER PROTEIN 33A (ZINC FINGER. PROTEIN KOX31) (KIAA0065) (HA0946) (FRAGMENT).//9. 40E−91//472aa//42%//Q06730
TESTI20028060
TESTI20028400
TESTI20028660
TESTI20029120//DUAL-SPECIFICITY TYROSINE-(Y)-PHOSPHORYLATION REGULATED KINASE (EC 2. 7. 1.-) (PROTEIN KINASE MINIBRAIN HOMOLOG) (HP86).//1. 90E−47//253aa//41%//Q13627
TESTI20029650
TESTI20030050//*Mus musculus* taube nuss mRNA, complete cds.//1. 70E−119//260aa//91%//AF222802
TESTI20030370
TESTI20030590//TESTIS-SPECIFIC PROTEIN PBS13.//1. 70E−33//117aa//61%//Q01755
TESTI20030710//*Homo sapiens* C2H2 (Kruppel-type) zinc finger protein mRNA, complete cds.//9. 80E−18//139aa//46%//AF159567
TESTI20030740//TRICHOHYALIN.//8. 30E−12//368aa//24%//P22793
TESTI20031090//VACUOLAR PROTEIN 8.//3. 80E−23//367aa//27%//P39968
TESTI20031170//Tektin A1 [*Strongylocentrotus purpuratus*]//3. 40E−91//397aa//45%//M97188
TESTI20031300
TESTI20031520
TESTI20031930
TESTI20031960
TESTI20032280
TESTI20032550
TESTI20032800
TESTI20032990
TESTI20033250//SALIVARY PROLINE-RICH PROTEIN PRECURSOR (CLONE CP7) [CONTAINS: BASIC PEPTIDE P-F] (FRAGMENT).//4. 50E−05//138aa//28%//P02812
TESTI20033270//Testis-specific protein [*Homo sapiens*].//1. 00E−22//120aa//47%//NP_067063
TESTI20033540//TRICHOHYALIN.//1. 80E−13//443aa//22%//P37709
TESTI20033560
TESTI20033760
TESTI20034130//Zinc finger protein 106//9. 30E−263//781aa//66%//T14273
TESTI20034180
TESTI20034190//*Homo sapiens* very long-chain acyl-CoA synthetase (BG1) mRNA, complete cds.//3. 00E−131//468aa//53%//AF179481
TESTI20034980//TRIPLE FUNCTIONAL DOMAIN PROTEIN//1. 00E−77//250aa//55%//O75962
TESTI20035120//SYNAPTONEMAL COMPLEX PROTEIN 1 (SCP-1 PROTEIN).//9. 30E−06//459aa//20%//Q62209
TESTI20035410
TESTI20035510//Proliferating-cell nucleolar antigen P120-like protein—*Archaeoglobus fulgidus*.//3. 00E−12//200aa//35%//F69504
TESTI20035740//A-KINASE ANCHOR PROTEIN 150 (AKAP 150) (CAMP-DEPENDENT PROTEIN KINASE REGULATORY SUBUNIT II HIGH AFFINITY BINDING PROTEIN) (P150) (FRAGMENT).//4. 50E−09//357aa//21%//P24587
TESTI20035800
TESTI20035890
TESTI20036250//IMMEDIATE-EARLY PROTEIN.//1. 60E−07//120aa//35%//Q01042
TESTI20036490//GLYCOPROTEIN X PRECURSOR.//7. 40E−06//107aa//31%//P28968
TESTI20037270
TESTI20037810
TESTI20038940

TESTI20039140//Tektin A1.//2. 10E–68//410aa//36%//A46170
TESTI20039980//T-CELL RECEPTOR BETA CHAIN ANA 11.//4. 40E–13//123aa//40%//P06333
TESTI20040000//*Rattus norvegicus* cca2 mRNA, complete cds.//5. 60E–82//179aa//86%//AB000199
TESTI20040310
TESTI20041110
TESTI20041220//*Babesia bigemina* 200 kDa antigen p200 mRNA, partial cds.//4. 60E–05//481aa//19%//AF142406
TESTI20042070//*Columba livia* mRNA for 5'-nucleotidase.//8. 20E–113//317aa//67%//AJ131243
TESTI20042290//MHC CLASS II TRANSACTIVATOR CIITA.//6. 30E–05//89aa//43%//P79621
TESTI20042430
TESTI20042870//X INACTIVE SPECIFIC TRANSCRIPT PROTEIN (FRAGMENT).//2. 40E–06//155aa//32%//P27571
TESTI20042950//AMINOPEPTIDASE B (EC 3. 4. 11. 6) (ARGINYL AMINOPEPTIDASE) (ARGININE AMINOPEPTIDASE) (CYTOSOL AMINOPEPTIDASE IV) (AP-B).//4. 40E–19//141aa//33%//O09175
TESTI20047120//POTENTIAL PHOSPHOLIPID-TRANSPORTING ATPASE IK (EC 3. 6. 1.-) (FRAGMENT).//1. 00E–86//169aa//98%//O60423
TESTI20049290
TESTI20049820//CGMP-DEPENDENT PROTEIN KINASE 1, ALPHA ISOZYME (EC 2. 7. 1. 37) (CGK 1 ALPHA) (CGKI-ALPHA).//6. 60E–07//187aa//26%//Q13976
TESTI20049940
TESTI20051550
TESTI20052680//*Rattus norvegicus* RSD-6 mRNA, complete cds.//4. 20E–61//261aa//55%//AF271155
TESTI20053960//ZINC FINGER PROTEIN 132.//0// 589aa//99%//P52740
TESTI20054080//SER/THR-RICH PROTEIN T10 IN DGCR REGION.//4. 90E–117//263aa//82%//P54797
TESTI20054920
TESTI20055840//*Homo sapiens* Tandem PH Domain Containing Protein-1 mRNA, complete cds.//2. 70E–162//331aa//92%//AF286160
TESTI20056900//ENVELOPE GLYCOPROTEIN GP340 (MEMBRANE ANTIGEN) (MA) [CONTAINS: GLYCOPROTEIN GP220].//1. 50E–06//171aa//32%//P03200
TESTI20057310//CHROMOSOME SCAFFOLD PROTEIN SCII.//1. 90E–05//297aa//20%//Q90988
TESTI20057420//ENDOZEPINE-RELATED PROTEIN PRECURSOR (MEMBRANE-ASSOCIATED DIAZEPAM BINDING INHIBITOR) (MA-DBI).//5. 20E–225//501aa//83%//P07106
TESTI20058600//MYELOID UPREGULATED PROTEIN.//2. 20E–68//167aa//74%//O35682
TESTI20062380
TESTI20062550
TESTI20064250
TESTI20064830//*Homo sapiens* RAN binding protein 16 mRNA, complete cds.//5. 00E–163//414aa//64%//AF064729
TESTI20065720//PROTEIN D52 (N8 PROTEIN).//1. 00E–22//129aa//46%//P55327
TESTI20067740
TESTI20068660//*Homo sapiens* infertility-related sperm protein mRNA, complete cds.//5. 90E–197//365aa//99%//AF311312
TESTI20068720
TESTI20069780
TESTI20069790
TESTI20071830//*Homo sapiens* transcriptional intermediary factor 1 gamma mRNA, complete cds.//1. 40E–125//233aa//99%//AF119043
TESTI20073580
TESTI20074020
TESTI20074640//ZINC FINGER PROTEIN 85 (ZINC FINGER PROTEIN HPF4) (HTF1).//3. 20E–119//428aa//45%//Q03923
TESTI20074660//ZINC FINGER PROTEIN 91 (ZINC FINGER PROTEIN HTF10) (HPF7).//1. 30E–194//509aa//68%//Q05481
TESTI20074800
TESTI20076130
TESTI20077490
TESTI20077500
TESTI20078140//D7 PROTEIN.//1. 10E–25//99aa//49%//P13007
TESTI20078640//*Homo sapiens* zinc finger protein ZNF232, exon 4 and complete cds.//2. 60E–61//119aa//99%//AF080171
TESTI20078670//RING CANAL PROTEIN (KELCH PROTEIN).//8. 90E–09//269aa//20%//Q04652
TESTI20078720//INTRACELLULAR PROTEIN TRANSPORT PROTEIN US01.//2. 90E–17//417aa//24%//P25386
TESTI20079510//NEURAL CELL ADHESION MOLECULE, 140 KDA ISOFORM PRECURSOR (N-CAM 140) (NCAM-140) (CD56 ANTIGEN).//0//723aa//96%//P13591
TESTI20080200//DPY-19 PROTEIN.//7. 50E–114//621aa//38%//P34413
TESTI20080330
TESTI20081390
TESTI20081440
TESTI20082340
TESTI20082400
TESTI20083430
TESTI20083870//CALCINEURIN B-LIKE PROTEIN (CBLP).//1. 80E–73//169aa//82%//P28470
TESTI20084400
TESTI20086570//MELANOMA-ASSOCIATED ANTIGEN B4 (MAGE-B4 ANTIGEN).//4. 20E–88//347aa//52%//O15481
TESTI20087740
TESTI20088470
TESTI20136910
TESTI20138320//*Xenopus laevis* transketolase mRNA, complete cds.//1. 30E–128//315aa//75%//AF270484
TESTI20140360//XAA-PRO DIPEPTIDASE (EC 3. 4. 13. 9) (X-PRO DIPEPTIDASE) (PROLINE DIPEPTIDASE) (PROLIDASE) (IMIDODIPEPTIDASE).//1. 40E–55//111aa//98%//P12955
TESTI20177400
TESTI30000020//*L. mexicana* lmsap2 gene for secreted acid phosphatase 2 (SAP2).//2. 00E–11//361aa//24%//Z46970
THYMU10000020//*Homo sapiens* mRNA for Golgi protein (GPP34 gene).//2. 20E–135//274aa//95%//AJ296152
THYMU10000320
THYMU10000830//SUCCINATE DEHYDROGENASE [UBIQUINONE] FLAVOPROTEIN SUBUNIT, MITOCHONDRIAL PRECURSOR (EC 1. 3. 5. 1) (FP) (FLAVOPROTEIN SUBUNIT OF COMPLEX II).//7. 30E–84//185aa//87%//P31040

THYMU10001050
THYMU10001760//SIALOADHESIN PRECURSOR (SER).//2. 50E-42//127aa//71%//Q62230
THYMU10002910//*Homo sapiens* AP-4 adaptor complex beta4 subunit mRNA, complete cds.//1. 30E-64//129aa//97%//AF092094
THYMU10003290
THYMU10003590//BETA-CHIMAERIN//2. 00E-23//200aa//31%//P52757
THYMU10003660
THYMU10003820
THYMU10004590//T-CELL-SPECIFIC TRANSCRIPTION FACTOR 1 (TCF-1) (T-CELL FACTOR 1) (TRANSCRIPTION FACTOR-7).//3. 70E-89//172aa//97%//Q00417
THYMU10004730
THYMU10004910//*Homo sapiens* protein serine/threonine phosphatase 4 regulatory subunit 1 (PP4R1) mRNA, complete cds.//3. 70E-49//144aa//65%//AF111106
THYMU10005270
THYMU10005580//*Homo sapiens* Sec22 homolog mRNA, complete cds.//7. 00E-139//264aa//98%//AF100749
THYMU20001400
THYMU20002360
THYMU20003170//*Homo sapiens* topoisomerase II alpha-4 (TOP2A) mRNA, partial cds.//5. 80E-09//92aa//42%//AF285159
THYMU20003690//*Mus musculus* syntrophin-associated serine-threonine protein kinase mRNA, complete cds.//3. 20E-189//481aa//73%//AF077818
TRACH10000180
TRACH10000300//Anabaena PCC7120 hetC gene, complete cds.//7. 00E-12//200aa//29%//U55386
TRACH10000570
TRACH10000630//CDM PROTEIN (6C6-AG TUMOR-ASSOCIATED ANTIGEN) (DXS1357E).//5. 00E-124//246aa//100%//P51572
TRACH10000740//Ig delta chain (WIE)//6. 90E-251//513aa//90%//S17597
TRACH10001000//*Oryctolagus cuniculus* PiUS mRNA, complete cds.//6. 50E-33//68aa//95%//U74297
TRACH10001060
TRACH10001250//Ig delta chain (WIE)//1. 60E-233//513aa//85%//S17597
TRACH10001400
TRACH20000150//DPP2C1//4. 70E-05//152aa//30%//AAC28998
TRACH20000790//*Xenopus laevis* Churchill protein mRNA, complete cds.//4. 10E-47//112aa//71%//AF238862
TRACH20001850
TRACH20001960
TRACH20002350
TRACH20002370//ZINC FINGER PROTEIN 184 (FRAGMENT).//5. 40E-61//275aa//38%//Q99676
TRACH20002500//HYPOTHETICAL 65. 2 KDA TRP-ASP REPEATS CONTAINING PROTEIN D2030. 9 IN CHROMOSOME I.//1. 10E-82//375aa//42%//P90794
TRACH20002890//GROWTH FACTOR RECEPTOR-BOUND PROTEIN 7 (GRB7 ADAPTER PROTEIN) (EPIDERMAL GROWTH FACTOR RECEPTOR GRB-7).//3. 90E-188//346aa//98%//Q03160
TRACH20003930//*Rattus norvegicus* matrin 3 mRNA, complete cds.//4. 40E-192//371aa//96%//M63485
TRACH20004110
TRACH20004200//MAJOR SURFACE-LABELED TROPHOZOITE ANTIGEN PRECURSOR.//4. 40E-06//96aa//33%//P21849
TRACH20004610
TRACH20004720//1-AMINOCYCLOPROPANE-1-CARBOXYLATE SYNTHASE 2 (EC 4. 4. 1. 14) (ACC SYNTHASE 2) (S-ADENOSYL-L-METHIONINE METHYLTHIOADENOSINE-LYASE 2) (ACS-2).//5. 40E-56//396aa//31%//P18485
TRACH20004960//*Rattus norvegicus* kidney-specific protein (KS) mRNA, complete cds.//2. 90E-282//573aa//88%//AF062389
TRACH20004970//Transacylases//7. 70E-11//151aa//32%//AAB94954
TRACH20006650//*Rattus norvegicus* mRNA for putative integral membrane transport protein (UST1r).//3. 30E-187//552aa//62%//Y09945
TRACH20006750//RADIAL SPOKE PROTEIN 3.//1. 90E-50//156aa//48%//P12759
TRACH20007670
TRACH20007800//*Homo sapiens* PTH-responsive osteosarcoma B1 protein (B1) mRNA, complete cds.//8. 40E-230//339aa//98%//AF095771
TRACH20008940//PROTEIN TSG24 (MEIOTIC CHECK POINT REGULATOR).//1. 50E-202//384aa//97%//P53995
TRACH20008980
TRACH20009260//PROBABLE OXIDOREDUCTASE EPHD (EC 1.-.-.-).//5. 80E-22//201aa//33%//Q10402
TRACH20009440//ZINC FINGER PROTEIN 91 (ZINC FINGER PROTEIN HTF10) (HPF7).//3. 80E-07//89aa//39%//Q05481
TRACH20011920
TRACH20012890//SEX-LETHAL PROTEIN HOMOLOG.//1. 20E-07//115aa//33%//O17310
TRACH20013950//*Homo sapiens* NY-REN-25 antigen mRNA, partial cds.//2. 20E-50//104aa//56%//AF155103
TRACH20014000
TRACH20015920
TRACH20016070
UMVEN10001220
UMVEN20001330//RABPHILIN-3A.//2. 00E-18//272aa//30%//P47709
UTERU10000770//GAMETOGENESIS EXPRESSED PROTEIN GEG-154.//5. 30E-33//73aa//97%//P50636
UTERU10000960//VACUOLAR ATP SYNTHASE SUBUNIT H (EC 3. 6. 1. 34) (V-ATPASE H SUBUNIT) (V-ATPASE M9. 2 SUBUNIT) (9. 2 KDA MEMBRANE ACCESSORY PROTEIN).//1. 60E-15//68aa//51%//O15342
UTERU10001600//ZINC FINGER PROTEIN 191.//3. 20E-90//346aa//52%//O14754
UTERU10001920
UTERU20000470//*Homo sapiens* neuropilin-2(a0) mRNA, complete cds.//5. 00E-20//61aa//80%//AF022859
UTERU20003380
UTERU20003930
UTERU20004850//X-linked retinopathy protein//1. 10E-16//97aa//51%//A46010
UTERU20005410
UTERU20005690

SEQUENCE LISTING (3381 sequences)

SEQ ID NO: 1 - DNA, 2526 bp, Homo sapiens
atgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgcgctgcccaggagtctcttggggccgctgcaagtgggcaggtgccctggtgttctcgtgggccggccccaggccctttgcggagcgtgtgccgcgctgaaggaaggggccgtccccccttaccatgccccattcttttgggcttgggggaccgaactaactccccccgcccccacttgcaaagttcagcctccgctttagaagctgacctctcagtttcacttggatgtgtttcttcttcagtctccaagaagagtttttagacaaacacacactgatgagagtgctttcaagtggagggaagttaggaagtcgtggcgagggagcgcagctgtgctgctggatgttgctgttttcctggcgtgttagcggtggtcagcagacaaggcgcctctgtcgaagagccttctgctggtccccagtgccctctccctcctgctcgccctcctcctgcctcactgccagaagctctttgtgtatgaccttcacgcagtcaagaacgacttccagcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggaactgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttt

SEQ ID NO: 2 - DNA, 2370 bp, Homo sapiens
atcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttgaggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcatgtcttgctctgagagttcaagtcctgccgggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgt

SEQ ID NO: 3 - DNA, 2264 bp, Homo sapiens
actgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccccaatttaaaatgtggaattcagttggtgtccaagacttatcttgagactcttaaaagcatcagtctgtaactagaacaaatacagtcttagatttacccaagtgcctagatatcattttataatgattagaattgagtattgtgggtcccctaattctgtgggtgccttaagtgagaatttctaaatgattttcacattctaaatgactttgggttttgaactctccatctagtttacttctaaaatgggaacttgaggcaattcaggtatccaggcaaatctttgtatatatttttttgtgtacatgcacacatctcgaaatccatttccgtgtttaatgttagttgtttatgtgttagtattcctgtgtctactgttttgttgttgttaatatgggtaaagtgagccctgaaatacatgctaaacaagacatgaaattcagaaaggtacatagtgtttcaagtgcatggtagtttgatctgtgttttactttattgtgttttcttgagtgtaaagaaagaataaatcaaagttcttcatacccattttgacaaagtggaacagtggagctgttttttgcttttgtttttatttattttttgccactggtgatgatagatttcaaaaaacaaaaggtggcagcagcacaatgttcatggtgaattatctcatagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctct

SEQ ID NO: 4 - DNA, 2360 bp, Homo sapiens
gtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggatccaaacggggtgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagattccagaaacaaggaagaggaaagactaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctatacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctg

SEQ ID NO: 5 - DNA, 1755 bp, Homo sapiens
atctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgatgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgat

SEQ ID NO: 6 - DNA, 1395 bp, Homo sapiens
aaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggtggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcggtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcgcctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattg

SEQ ID NO: 7 - DNA, 1796 bp, Homo sapiens
acacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctgttcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccatccttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattattttt

SEQ ID NO: 8 - DNA, 1575 bp, Homo sapiens
ctttttggccctgtgacacgtagcaacggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccttatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctaggaatgttttgtttattaaacttaatgagtatgacaggtgtttcatttggttgtgtggcaagtgtccttggatattgtcttctgcccatgatcctactttccagctttgcagtgatattttctttgcaaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctc

SEQ ID NO: 9 - DNA, 1678 bp, Homo sapiens
agtcgttgccacccgcggagatgaaatgtgagcctgggtggccaaggacgccggagtggccgccttccccgcgcctgagcgcagtggggcgagacaaagagacctgggcccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtctttggaatagtatttatcatgggggtcattgctgggattgccatatgcatctgcatgtgcatgaagaaccacagggcgacccgcgtgggcatcctcaggacgactcacatcaacaccgtctcctcctatcctggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggatgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtgggga

SEQ ID NO: 10 - DNA, 2197 bp, Homo sapiens
ttttttccgtgggagtaaggaagtgcttttgaatgaggtactgggggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaaggcatggatagagtccagtgttctggtgatctacaattggctcaccagcttcagcaagaagaagacagaaagaggagatctgaagaatcaagacaagaaatagaagaatttcagaagctgcagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacgacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatctctaaaatgcctgtgttaattgaattatacctatcatacttcattgtttggtaaattatttcaataaaatgtcttgtttttgcattgtg

SEQ ID NO: 11 - DNA, 1697 bp, Homo sapiens
aaatagctgggactggcttcctgccggggcggccccagaggctgtcccttgcagacacatgcccctttcacggctccctctcagggttggccagaaggaatttttttttccgctccccctcctggtccctcccatttcctggctcctcctctctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctgcagaccaatctggggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcaatgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttg

SEQ ID NO: 12 - DNA, 1523 bp, Homo sapiens
tttcaaacgctcaggtttcctaccttccggctgcttgggaacttctttcttgcccgccaagcccgcagccacccgggcgcggcgggactcctagacccggcgctgcgatgaagaggacccgcgacgaggtggatgcgacgctgcagatcgccaagctgaatgcggccgagctgctgccggcggtgcactgcctgggcttcggccctggggccagcggcgctgcagccggcgacttctgcctgctggagctggagcccacgctgtgccagcagctggaggatggacacagtcttgtgattcgtggtgataaagacgagcaagctgtgctgtgcagtaaagacaaaacatacgacttgaagatagcagacacttccaatatgttgcttttcattcctggttgtaaaactccggaccagttgaagaaggaagattcacactgtaacattattcacactgagatctttggtttttctaataattattgggaattaagaagacgtagacccaagttaaagaagctaaagaaacttttgatggaaaatccatatgaaggacctgacagtcaaaaagagaaggattcaaatagctcaaaatatacaactgaagatttgcttgatcaaattcaggcaagtgaggaagaaataatgacccaattacaagttctaaatgcctgtaagattggaggttattggaggattcttgaatttgattatgagatgaaacttctgaatcatgtaactcagcttgtggattctgaatcatggtcttttggtaaagttcctttgaacacatgccttcaggaactcggaccattggagccagaggaaatgatagaacactgtcttaaatgttatgggaagaaatatgtagatgaaggcgaagtttattttgagttggatgctgataaaatatgtagagcagcagcacgaatgctacttcagaatgcggtgaaattcaatctcgctgagtttcaagaagtgtggcagcagagtgttcctgaaggaatggtaactagtcttgatcagcttaagggtttagcgctggtggatagacactcgagaccagaaatcatatttttgctgaaagtagatgatttacctgaggataatcaggaacgttttaatagccttttctctctaagggagaagtggacagaagaagatattgctccatatattcaagatttgtgtggagagaagcaaaccataggtgcattactcactaaatattctcattcttcgatgcaaaatggtgttaaagtttataattcgagaagacccatttcttaaaagaacaacggtcttttcttcaggactcaagttgctttataaagttgctggatagaagaaaaataacttgtacttttatttctgacttttagaaacctagtcttctaaggcatttttctcctcatcttaagcattttgaaactactgttatttcttaaatgttataggatgtagctttaaaattatatttgtactatgtacacagtgtaaacaaggacaaaagaattctttcct

SEQ ID NO: 13 - DNA, 1379 bp, Homo sapiens
agtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccagttggctaaatcaagaacagttttaataagtgtttcttttgggcaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggt

SEQ ID NO: 14 - DNA, 1894 bp, Homo sapiens
gaagtgtccgtgcagcgagcaggagctcgcgctgggagggcagacaagtggtccagtggaagtgtccgtgctgcaagcaggagcgctagtgctgggagggcggacacgtggcccaggcggaagtgtccacgcctacctcgagcaggagcgctcatgctgggaaggcagatgggtggcccgggcagaagtgtctgtgctgcaagcaggagcgctcatgctgggaaggcagacacgtggcccaggcgtcaggtttgaacattcttgacagcaagtggctcacccgtcagcgtgctgctttttcccatcccaggagttggacttgacctgtggacatttggctgttttctttttgtttttaagccagaaacactgtcttgtttccagtttaagatgtagagagggtgaaacagtcagaaactgggtcagaagcagcgtggttctcgtggcagggcggcacttggcccaagactcgtgctttggcgggaggctcaagtcaggcgtcccagcagcttcggtgcaacgcctcctgcccggctgcgtggggaggccctccaagacaccagctggtctcaccgcggggcctgacttcgagccagagcagcgagtacattgcgtctccgtgtggcaagggcaggtgtgggggtctcagtccactaccgagcagcctgctctgatgactggcggcgccagggagaagggtcacatcgcgaggtccccagcaacggctcaaggccctgccctgggagaagccctgccacacgtcgtgcccacgctgagggcctgtctgcagccctcccaagacccgcagatgcgcctgaagctgttctccatcctgtccaccgcgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaagatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccgctctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaac

SEQ ID NO: 15 - DNA, 1990 bp, Homo sapiens
agagtccttctgtcggttggtcctggagcggcgcagccggagtggggccgtgaggctggaatgcagtgacatcatctcagagctgactgcaacctctgcctcctggattcaagcaattctcctgcctcagcctcccgagtagctgggattacaggcggatgccaccatgcctggctaatttttgtatttttggaagagatgggttttcaccatattcgccaggctagtcttgaactcctgacctcaagtgatccactctcctcggcctcccaaagtgctaggattgcaggccactgtgcctggccaagaggtcacttttcatgtccaggctgcatggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagcc

SEQ ID NO: 16 - DNA, 1702 bp, Homo sapiens
aggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaaccccca

SEQ ID NO: 17 - DNA, 2315 bp, Homo sapiens
gtgcagccgcgggtgcaggagtcctggggcatggcgggggcggggcagggggaggcgcgcacagaacaggctggggcatccctcgccctggctctttgagcccggaccagacaggtgctgggaatacagcaaggaattagaccagttccctgctctctggtatggtgggacagatactaaaaagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 18 - DNA, 2077 bp, Homo sapiens
aatcaggcgcgtccctctggcgctggagccaggacctggcgttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggagtactgccttccccaggccctgcccttccccaagaggaaaacacaggagaggaaggaatggctgctggtctcctcatagctgggccccggggatccacattcttcagcagtgtgacggtagcttttgcacaggaagggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaatgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgt

SEQ ID NO: 19 - DNA, 1655 bp, Homo sapiens
aatttgggaacgagatgcccggggatgcaaccagccccgcgctcggaggcggcggtcggagttccgtgcgcagagggcacacaaaagcctcgaggatcattgcctcgaccccatcccccaccgcgcggcgacgccccctacgggctgggacacctccaccctcggactgctgccgggtttccctccggctgcgaccctggagagtttgccatctccgtaccaccaccaccaccacacacagcaccctcaagactccctgtgatcctgggatgcactcaacgaagagtgtgtggcccaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactgagaaaccaagtcatgctgaagacctggaaatcccagcaggctgcaaaccagctgcaactacaatgggtcagcccttttgagatgctgctgactacccacttatctgccaagttagccagtgttaagccatggattcaccacgctcagataaaacctgcccctctgggatccctccagaaaaaaacaggcatgctgttgtgaaccctaagatggccttaagttaatattcaatgcccagccaaagaccctaaataagaagtcataaaggaaacatgtgcttttcaggtaccaatcaccctccagatctaagaatggcttcaggctggggctgcagtcacctctttgcccagcttctcccctgccctattctgcttcacttgcatctttaaaggttccacccaagagctcttctacaagaaagcacctataaagccagacacattggcttatgcctataatcctagcactttgggaggccaaggtaggaggatggcttgaggccaggagttcaagaccagcctgggcaacttggtgaggccccgtctctataaaaaataaaaaaattaaccaggtgtggtggtgcacgtctctagtctcagctactcaggaggctgtggcaggaagatggcttgagcccaggaggttgaggctgcagtgaactaagatcatgccactgcacccatcttgggcaacagaatgagatcctgtctctaaaaaaataaaaacaatttacaacagtaagcacctgtacacaagccccatctccagtcctgtttctagggcttccaatttaacacacctagaggctgggcatagtagctcatgcctgtaatcccaatactttgggaggctgaggcaagtgaagcacttgaggtcaggagttcgagaccagcctggccaacatggcaaaaccccatctctactaaaaatgcaaacattagctgggcatggtggcacatgcctgtaatcccagctactcgggaggctgagacaggagaatcacttgaacccaggaggtggaggttacagtgagccaagatcacaccactgtaccacagcctgagcaacgaaagaagactctgtctaaaaaaagtaaaaaataaaataaaacacacctggagctttct

SEQ ID NO: 20 - DNA, 2075 bp, Homo sapiens
attaatactcccagcttctctaaaacctcaaataaagcaatactaacacctgaaaaaacaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgtcttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagc

SEQ ID NO: 21 - DNA, 2195 bp, Homo sapiens
aaaagcatgtcaggctctgggcgaaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcgtcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctagaaatgggatttccccatgttgaccaggctggtcttgaactcctgacctcaggtgatccacctgcctcggcctcccaaagtgctgggattacaagcgtgagccaccttgcctggcccctagttcaatgaatgtttttatcatgaaaagggtattggattttcctgtatctattgaaatatgcatgtgatttttgtcttttttcaattaattagtagagtatattaaattaaaattttcagatgttaatacacattgtctttttcaaatacattacacttagtcacagtgtagaactctttttatattttgctgtatttctttatttgtttgttagtattttgtggaagatttcacatctatagtcacaagagatactggtctagagttagttatcatgtctctgtctggtttaggtatcaaggtaatattggcaccatggatgaattgggaaatgttttctcatattcagttttgtggaatattttgtagtggattggtggcaaccacaacattacagagaaggagataaaaataagcatatttaaacctc

SEQ ID NO: 22 - DNA, 2483 bp, Homo sapiens
ctattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaattagccattttcctcaagaaaagtgattcttctgaatcttagcttttcagtaatgagaactggactgtttccacttgacctctatttcctgttagtgggaaaccgcttcccagaggtgctgtgtgaaagattgctggggaaagggtttctagatcccagcataacaagttcaagagtccagcgatattgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaatgttttagtttacttagttaattccttaggtttggacattacaggagacatgggggtgaccatagcaatttagctgataaatgtatcagaaactctttcatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaaggattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttgtctatact

SEQ ID NO: 23 - DNA, 2917 bp, Homo sapiens
acgccggctgggcgcgtccgggacttactcctttccgcagggcagcacccagggacctgagtgttgcaaggtgcgagaggggagcgccgcggggagcgccgcgggaagcgcatgtgcctcaaattcctgcctttcctcaagagaagagcccccaggagaaaagccagtattgcttgtgctcctaacaacctgtctcttgagaggctgatcatcaggggttcactttcagagaagttgagaatgcaggctgaacaaggaagaggaaggggaatcctgcagggatgaatgagaggacagcaatgcatgtgtgatgtgtgtgagcacacacacacagtaacctttcctaggagaactgtattactctaatgataatcacctttgaggaaaaaaaacttgtaagtatgaatttggtgttacaagcagcatgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaaaccatataaatgtacagaatgtggcaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaaaatttggaatataatgagtatgggaagatttgtatggaagcacctttttttttctcctaaattcctaggaatgtaagactcaatctgtagctagtatgaatattttgtattttgaacaagaaatgttgtgtcctaatgtgtcctagtctggagtttgatgccttatctgccgctcagtgggtgtaaccttatcccttctgagcctcagtttccccattccccccaatagaaaaatggggatatttcctagggttgtcctgagaataaaatgagttctgtgtgacagttaactgccatattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagccttttaatgtaaacaagcacctctaacgctaaaagcacccttgcaagaaaggtaggagttactattcacatcctagagtcaaggaaaaagagaagatgtttgacttgctcaaagtcaagcaggtgatgtcagaattgaatctcaaatctatatctttatagatttgcagttctggtttatataataccaaagtcacatacaggtaatttcccaccattgaaccttcctgttggtgtgagatgccaaatctgtgaaaaccagacacaggtggccaggtgggtgtcgaactcctgacctcaagtgatccgcctgcctcagcctcccaaagtgctgggattacaggtgtgagtcaccacatctggtcggattttaactattctaataggtatgtagtggtattaattgttttaatctgcagttcaccaataatatatgaatttagcatcttttcatatgtttgccatctgtatagctttggtgaggtatctgttagaggttttgcccatttttaattggattgctcattttcttattgttgaattttaagtgttccttgtatattttgtataacagacctttatcagataggtcttttgcaaatattttcctcccaggctgtggcttattttctcaatccttgattccttctctttactttttttttcttttttctttttttaaagaaatggtagcataatatacacagttgtccattttttaaagactaaaccatctcacagattgttctgtatcagtaaataaagatctttcccccaccctt

SEQ ID NO: 24 - DNA, 1915 bp, Homo sapiens
agtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctccccatctatctgcttggcctgactcagaaattcgggcccatctacaggctccaccttgggctgcaagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccgacacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctggggcagcacaaggagagcctcgtggcaggccagtggagggacatgatggactacatgctccaaggggtggcgcagccgagcatggaagagggctctggacagctccaggaagggcacgtgcacatggctgcagtggacctcctgatcggtggcactgagaccacagcaaacaccctctcctgggccgcggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 25 - DNA, 2135 bp, Homo sapiens
accctcccagccccggacagcgcatgctgcggcttttcgtcctccactgagtcctgccggtggcccgagctcggtggcctcccggcgaccctcagcgcgaggcgacatggcaggcggccacagcctcctgctggagaacgcgcagcaagtggtgttggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtatcctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaaaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatggagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaatttttgattctttacattacaattgggtgaaacacattttacagctctcaataaatgtttgctgtcgctctt

SEQ ID NO: 26 - DNA, 2723 bp, Homo sapiens
ggtgaaaattagacagtgaaaatataaaagtaaattactattttcataaatgtatataggcacacctcattttattgaaccttgctttacaaattttaaccttgtggttaaaacaaccacagatactacattttttacaaattaaaggttttggcaactgtgtggagcaagtttattggcagcatttttttccaacagcacgttctttctctcttttggcctctgttacattttggtaattcttgcaataactaaaacttgttcattattatcacacctgttacggtaacctgtgatcagagatcattgatgttactgttgtaattgttttggggtgccatgaaccagaaccatgtaaaacggcaaactcacttgttaagtgttgtgtgtgttctgaatgccccactgacctgttgttctgccatctctgtccttctccttgggcatccctattctctgagacacaacaatattgaaattaggccagttaagcctacaatggcttctaagtattcaggtgaaaggaatagttacatgtctcttactttaaatccaaagctagaaatgacgaagctcagtgaggaaggcatgtcaaaagccaatatgggacaaaagctagacctcttgcaccaaaactagccaaattatgaatgcaaaggaaaagttctggaaggaaattaaaagtgctactttaatgaacgcacaaatgagaagaaagcaaaaccttattgttgacatggagaaagttttagtggcctgagtagaagatcaaaccagccacactattcccttaagccaacgtctaatctaggggaaggccctaactcacttcaattctatgaaggctgagagaggtgaggcagctgcggaagaaaagtaggagactaggagaggctggctcacgaagttaaggaaagatgccatctgcataacatagaaatgtaaggtgaagcagcaactgctgatggagaagctgcagcaagttatccagaagacctagctaaaataattggtgaaagggcctacactaaaacaacaaatttttagtgaaaaacgcagctttgtattgggagaagatctcctctggactttcatagctaagaaggagaagttgatgcctggcttcaaatctttaaagaataggttgactcttctattaggggctaatgcagctggtgaccttaagttgaagccaatatgaatttaccattctgaaaattttaaaacaagaattatgctaaatctacgtagcctgtggtaagtggaacaaaacctggattacagcacatctgtttatagcatgatttactgaatatttttagctttcttttgagacctagtgcacagaaaataatattcctttcaaagtagtactgctcattgacaatgcacctggccatccaaaagctctgatagagatgtacagggagattaatgttgttttcaggcctgccaatggaacatctattctgccacccatggatcaaggagtaattttgactttcaagcattatgattcaagaaatacatttcatggggatatagattccatagatagtgattcctctgattgatctgggtatagtcaattgaaaaccttctggaggctgggcatggtggctcatacctgtaatcccagcaatttgggaggctgagaagggcagatcttctgaggtcaggagtttaagactagcctggccaacatggtgaaaccctgtctctactaaaaatacaaaaactagcctggcaaggtggtgcacccctgtaatcccagctactcaggaggctgagtgaggcaaggcaggagaattgctggaacgtggaggcagaggttgcagtgagccgagatcccgccactcactccagcctggataaaagagcaagactccatcgcaaaaaaaaagagaaaaccttctggaaatgtttcattactctaaattgcattaagaacaaggaggtcaaaatatcaacattaatagtactttgaaagaagttgattccaactcccatggatgactttgaggggttcaagacttcagtggaggaagtaactgaagatggtctggaaatagcaagataactagaattagaagcagagcctgaaaacgtgactgaattgctgctacctcataataaatccttaagggatgagaggctgcttgttatggacgagcaaataaagtggtttcttgagacagcctctacttccggtgaagatgcgatgaactttgttgaaatgacaacaaagggtttagaatattctgtaaacttagttcgtaaagcagccacagggtatgagaagattgactccagttttgaaagaagttctaatttgggtacattgttatcaaacggcaacgcatgctacaaagaaatcttttctgaaaggaagagtcaattgatgaggcaaacttcattgtcttattttaagaaatcatcggccaggcatggttgctcacacctgtaatcccagcactttgggagaccgaggcgggcagattgcctgagctcaggaattcacaactagcctgggaaacccaggtgaaaccccatctctactaaaatgcaaaaaattagccgggcgtggctgcgtgctcctgtagtcccacctactcgggaagctgaggcaatagaattgcttgaacctgggaggcagagggtgcagtaagctgagattgtgccactgcactccagcctgggccacagagtgagattccatctac

SEQ ID NO: 27 - DNA, 2443 bp, Homo sapiens
attctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagc

SEQ ID NO: 28 - DNA, 2081 bp, Homo sapiens
cttcggaagtacctgttggagggagtgtagcagtaatggcttttcaaagcatgagaatcaataggcacattccaatgagcaaaccccaggaatccacctgttctcatcttgccaacaatgctccttccacggaaactgaccctgtcctatttcctcgctttgatcattgcccagaaggaacagggactgttgagaaacagaggcagcgtgcagcctgaaggcatgcaccgtgcagaagaggatccctgcggctgcgggctcttttccaggcccaaggacaaggcggtgtgtgccgggttgatctgcactgctttagccaggatggctcttcttagagagacaaaccgctccaacgccaaactgccctcgcaattccaatcgcaaaggcaggctagggccacagttcaaacccaactgccaatgtccacaaagaaaagaagaaagctggaaatgcagttggtcttgccatgctggccgctcagcttctcacccccaggcctaagaaggacaaggtgaggatgagttccatttacagagtcctcaccaggtgccagtcacgatctcaatgtctcacagctgccatcccgccaggctcccaggaggaaggtgctgctatttattatccacaggacagaccccacagctggcaagtggctgggccaggaaccagctagggcaggtttgtcccatactctctacccatgagcacgaggctgtgctgttcatgtctccattcaaacacaggctgatatttccactccaggggaaaaaaggtagaaaaaaaaatatatatatgtatgtatatacatttgagacagagtctcactctgttgcccaggctggagtgcagtggcaggatcacagctcactgtagtctggacttcccaggcttaaaggatcctccctcctcagcctcctaagtagctgggactacaggcacacgccgccatgccaggttcatttttaaatttttttgtagagacagtgtctcgctatgttgcccagcctggtctcgaactcctgacatcgagatccacctaccttggcctcccaaagtgctgggattacaggcatgagtcaccgcgcccaatcctccaccagcaattttcattctgcttttaccaataagaaccagagtcatctgaatcactgggatgcacagagtattacatactttaactgtgtattttagttaactgacaggacttccttcaaaggcaaatgcctgcagaccatcatcttcctctactgggccatcctagtcatcattctggaaaactctgttcttttgcccaatagcttcacacgctgtggtccagggctctctctcacaaacagcttgactgccgcaaccttcacaccatgggggcctgtgagacaccccacgtggatgggttggggccatggcacaggtctcgagggtcctgggtgctaaagactgtgcagaaggacggggtctgaccagtgaagcagccggcaacatctgcagacagtcactggctccaacttttgtttttgtcactgtgtcacccaggctggagtgcagtggtgcgacctcagctcattgcaacctccgcctcctgggttcaagtgattctcctgcctcagcctcccgagtagctgggattacaggcaggcaccaccacgcctggctaattttttgtatttttagtagcgatggggtttcatcatgttggccaggctggtctcaaacaactgacctcaggtgatccacctgcctcggcctcccaaagggctgggattacgggcgtgagccaccgcgcctggcctccatttatttgtaaataggtaattctcaacagtatgtttactctggataaacatcagtcagtgcgtagaactggtaaatgtcagagaaatgtatcacttatcagagcgtctcacagtctagtcctgtatttcttctgaactcacgctctgcaaagccagggctgaatgtatctaccatacctgcttgtttacctccaaaccttgcaatacatttatacaaaatatttatttcacagcttatcttaaaacaaatgtaaaaggtatcttcaaataaatcagactgaatctct

SEQ ID NO: 29 - DNA, 1721 bp, Homo sapiens
atttttcattttctgctcagacaccgttgcttgcaaaattccacccagaagataagggagggagtatcgctgcagcgtcctgctctgtgcctggttatattactggatccttgtgttgcagccctaagatagaaggattgtctccatttcacagatgagagagaactgatgcgcaggaggctgaaattgtctgaagtcacacagcagcctcctcttaaacatgacaaagaatccaaggacttgtgctggggctgtcagctgctattctggtgccctggggacgaagaagggatctggagggaagactgtcaccctcttgcgaatgtttccaagaagcagctcagcatgggagagaaaaggggagatcccagttccaggaacacctggccagtgtttcacctgtttatcggagttgacaggaccagccagccctttcccacctctccccatcatgatggatgggagcctggcctttgagattcctgcgaaggaatgacaaagaacatcaaggctcaatccttggaactctccatcactcatctttaaattagacttctctgctgactctcagagttgtgtatgctgagaatccactgcctctaagacatcctgcttggcaggttcctatctcccttcgactgaggcatcgtttccaaatcagacacttctcgtcaccactattgccctccccttgtccaacccacctttggctcttggctggagtccgaaagcacagaacgtggcacgttggaggaaatcagtaagtgtttgctaaaggtccaacaatgaaacagaacagatatatccagtgctatgccgcgtcaaaagagtatgagaggagcattccagcagccaggccttcagttgctccccgatcccagatggggaaaaccttgtgcggcacatttgcctcaggaagactgcactgggctccccggcgcccctaggacagcgtcccttcacgtcggagagactgggtgtgggccgtgaggtttaggaggctttaggagaaggaagatcctctctcaggagtgaaatgatcttatctgagaggatggaagtggtgagggcatcagcatgggtcctgggctgcggctgtgcctcttcctccccatgctgacacgtgcttgcccacaagcgccccgggcctctacatctcttggtagtttaaagctctattttagtctcaactagcagtttctctcactggtagatctaagttctaagactattcaatgggttctgtttctttttttaagaattaaaaaaactgttccagttaattcacggtcactatgaaaaaaataggcaggacatgtaaataaaagattaaaatatatacaaatcaaagaaggaagtacacccaggccagttatcaggcaagcttgccagacatcaatccagcaagaaaacgatagtgtgctttgaaaatgccaaatccggccgggcgggcggctcccgcctgtgatcccggcactttgggaggccgaggcgggcggatcacgaggtcaggagatcgagaccatcctggctaacacggtgaaaccccgtctctactaaaaatacaaaaaattagccgggcgtggtggcgggcgcctgtggtcccagctacttgggaggctgaggcaggagaatggcgtgaacccgggaggcggagcttgcagtgagccgagatggcaccactgcactccagcctgggcaacagagtgagactctgtctc

SEQ ID NO: 30 - DNA, 2855 bp, Homo sapiens
agtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatgtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaatttt

SEQ ID NO: 31 - DNA, 2403 bp, Homo sapiens
ctgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggctgtaccctgcaccgtgagccacccgcaggagaccaggagggcacagcactgcacctgcagacaagcctgccagccctttctgaggcagatacccaggaactaacccagggcttccggcctatgtcgctgtcaacccagacagtgttggtgatgctttgctccgagtctgcaggagctttgtggagacagagactttcctagcagggcagcaagcggaagcttttcttccagaacagcctttgctcagggcatgagggagccggccaggcccacagcgcccagggcatcctcctcacggatgtgttggaggaaagtggctttggtgctatcctgggggaccatggccataagctggcagtgtcagccacgcatcagttgcgtttctttgttcaggttgtgcctcttgctgcctgcctgagtcacccagggctgctccccttcctggctctgacgccctcagcgggtcccacaagccgctcaggaccacagagtctggccatgggtctggccaggcatccactgatgctctaagctgcagcttctcttaggaacacttctatcaggtctggctcgcaggcatgccccagggccagcctggattgtactgtccttcaagcactccttgctctatttctttgaagtttataaaagtttgtttcccccaaaacccaaagcacttttaatcaggtagtttctgtggaggtcgaactggctggaaggaaggctggttcctggatttctttactcatgtagcagggactcaaggaagtctgatttgcgcctcgcctctgactcagagcccatgaaggttcctgtgtgaggccactggctgcctcggagctgacagcatcctgcacaatggctagatggcttgtcaccccaggccgcagaggaacaactgtttctagggtttggccagacttcacattctccattctttccatccctgttatgtggaatgcacacgatggcatgtaattacttcagtcccttctcaaaggaaaaagaatctggacccgcactccaggacactagcagtttgaaggttcgctcaggaatgttctttgtctgcagacctagcagctgtacagatcgctcttgtgtttttgcactattaattaacttcaagtgcaattttggcaggcaggccaagggtctcaacaggctatttggaatgagttctcttttaaggccttcaacgtagtgagacattttcaaatcaaaaagtacagcaggagccagcctttattttgtctgtgtacacaataaaatattccgcttctataggc

SEQ ID NO: 32 - DNA, 2462 bp, Homo sapiens
atgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacagctgcagggttgtcctgcagccagtgtctgatgtgccccagctgggaagctgatgaatagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaagagcaccttgttctgtcccaggagaagcaacttgaacctttccacacttggcttcattttctccttttctgtaaggagggagattactcagttaatttctaaaataaagtacaagatcagtattttatcccactctcagaactacactgtccagtttggtcaccaactacaggtgatagagaagcacttgacatgcaacctagctggcacaactaaggaaccaaactttagattttatttacatactggatttcaaggcgttagcacaaagacaagaatacaaaataacgtttccgttaccgttagaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctac

SEQ ID NO: 33 - DNA, 2473 bp, Homo sapiens
acatgctataataaaaacaaaatgaaggaaataatgattaactggaattattacagtattgaatatgattctaaaataacaatggaaacagtcctttatagatttaggaatattttaaatcattgttgcactaggcacaactaacttttactttggaaatgatagaacttgccagaaaggtacatcttttacacagtagttaaaaattcattgtgtaatatcaaagttgtttcatgattgctcattaagcctcttgggttaactaacttaagaggttatttggtagtgttaagatgaaatttggatcagctaattccaagtttatattttcattattggatggatcagtaattctgctctccctcttgtaaacaagacgcattagggcttaacgtttatgacatgattttaaaccattttaaattgaatgttgatgagcaactaatattaagtgataacctctttggggaagtaggttaggtattttgtggtttgaattctatctactttatgacaattatagctaatttattaagtattcatgatgtgccagacacttgaaaaggctatgtgttaactcacttactcttcacaaaaccttatgagaaagatacttttattttccccatatcacagataaggaaactgaggcacaaagaaaagactgtaaggcagagccaggatttaagcccaggcctggtcccttagttttgggggggttttgtttgttttacagactataatttgagagaagtagattgaggagatagctcattgaaattgttcattttctgtatagaactagaaggcctaatttcatttttatttttacttgtgtcaacttatttttagacttggactattgagaatcttatatgttgttcctaaagcgacacacctaacagcttcaaaaggactatattacagttgaacccatggtagtttggatcctactgatacttgatgaggatctttacgtagtgttttatgttagttttgggtgatgtagttgagtcccccacttactgagtttacctactgtgtatgactgggctcaatgataaatagaatggttatatcaacactcaaatgagggctgacacacttcacctctccttttacttaagatctctctgcattttttttttttttgaagccaagtaagcaagaagaaaaatgagagataatgcttcagtgagagaggaaaggtgctacatagagtatgaactgttaagttacatcccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggtaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcac

SEQ ID NO: 34 - DNA, 2096 bp, Homo sapiens
aaaaacgcatctaggcaaagtgtggagccgaccaggcgggttttcctccttctcgcaactcctcctcctgcccccctccctcccaaatctcatctgagtgagtcagctgagggtggcagctcagaagcgaggcagccgtgaggcggaggacaggctggggaatcccaaagggtgcgctccagcccccaacccaggcactgggactctggtggcaccctgggtggcaggcaagccttgaaatcaagtgcacgagccttggaaaggaggaccgggagagttatggcatttatgaatgaagaagagaaagagaatcactcggatgggaaaagttaactggattgttcccacctgcatggatcaccgggatgaagctgtgccaccctgtaggaattagaagaccatgtccaggaattgagcactgggtgcaggatccagtcttctgaggccctgaaaccacatgggtcaccatagtgcgcttcatggggtgggaagtggtggcctctaagtgtctatcaactgtgaagactgcaaagagggatccatggctgttggagcaatgagatacgcgatgacgtagacagatccggaaagcgcatcgtctcctgagcagaagggcactcataagcaacttagccgtctcgccttgcggcctggaacccctggcaatttccggagcaccggcaagagacttttgcacagtttctgcttggagtctaccgactgtctgtctcagaggtctggacagctgcttgttacatttggctcacgctagcttaaaaaaggaatttatggaccttactgcagaacgtcccaattcttcaggccaaggtgcctgtgttcctgctcggtttctggattgcttggtacttaaatgaaacatcttattaatcatttcccgggaatgctgtgcaggcaaaaggaaaacaaaggcattcaggagccacaatgtcttgaacaagtcagcaaagaaaaacagttccgcctttggaatgtatgaaaatgaagaccgttgcaggaggtcttgagccacagagctggctccagaggcattgggaggagaaacgcggcaggcctggctcactcattatatttcaagatctatcccagcttgtcacaacatggactgtgtaactgagacgattcgcggttggtgttcccatgctgaggcatgtgctgccccggcccttggttgctgcgcaatttgctctctatggactgtacctggggtgcctaccctggacttcagacaagcttcttcaagagtagcccctgccagagctggagccaacagcaagagcagcccagggccactctgcccaggctcagaggcatcactgggaaagaggcaggggcagaaggaactggggcgggaagccctgaagggtgtcgagtcccaggacaagggactggggtgtgtcccagcagacccccagggaagcagcagctttggactcgcctgacccaaccccttgctgccagacaggcttaaattgccccaactttccccatgaagctcggacaggaggacggaggagcaactgccttctggggtcagagtctgtccccgctcctgcaggccggaagcacgtgcggtcagcggtgggccagagcctctcagcctctcagcaagggccttcctgtagctctcggctcctccaacagccccatcccttagcacaggcggggctggcggagcactgcaggggccaggtgcagccaccgtgcagcaaggcacagctgcctgatcaaaccagatcaaaagccattcgatcatccaaggactattttcattcgatatttattgatttctaccactcgctggggctgtacagggccctgagcttgccgtgaggagcacatttcagcccccaccccctcggggctcacagtctggtagaggaagcacatgaaataaaagaatttgcacatgtaaatatctcattacaaatgcgcaagagccatgaaggaaaaaaaaagaacacgatgggaggtaatcacaaagtccacttattttagacaaagtggttggcgacagccacatttttgccaagacctaaaggatgggcaacagtaaaaataaaaatcatcatcatcgt

SEQ ID NO: 35 - DNA, 1910 bp, Homo sapiens
accgaagccaccctgccctggtgaaagggctcccgcaccgcccggtgctccccatctgcctggcgttgtgcgcagagctggagagcatggctgttataaatgaattctgattttggggagcagatgccaacttagagcctcgtaccaatctctctgtctttaaaagatgaggtgacttggtgattttcctggaaaattatagcgatctttcagtgtaattggcctgaagtgaaaaccacagcctctgatggtgaacagaccacacgtgagcctgtgctcaaagccatgtttttggctgacacccatttgcttagggaattcctaggccactggctggacaaattacgaagagatggagttttgctgtgttgcccatgctggttttgaactcctggcctcaagtgatcctccctccttggcctcccaaagcattgaaattacagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagaccgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggcgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtgctgttctcatgctataaaagtggacaggtactctacaacaaatctgttttctcatttttatcaaatatatgtatcatcaaaggttgcatctgtacagtatgtaaatgctattaatgtcgtcactcacatgcacgacagcccttgttcccccaggaagggcctggtggccccagcacacacttgggattatgtgtatacataaataaatattgggctgtttccctctt

SEQ ID NO: 36 - DNA, 2277 bp, Homo sapiens
agtagcagcagcagcggcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcacagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccact

SEQ ID NO: 37 - DNA, 1930 bp, Homo sapiens
gtgcgacggtcacctcgtttgggtgagtccctgggttcgagcccgggccccgccagctgccgagttgcctctcggtgccggactgtgactccctctggccggccctgcactctggcctcctgggacgtcatctggagggatagagccaggcctgggactccttttgggagagtttccgttcttctattccgtgctgtccggccaggacccctcagggacttctgtggggcaggggcgaatcatgcatggcctagatgaccccatgcctagaaaaaggcagtgcggggcggtggcggcgcgcacggccgagtgaagcagatagcgtccccggggctggagcccggtagcagggccgggcgttgtggcgcgtgcctgtaatcccagctactcgggaggctgaggcaggagaatcgcttgaatccgggagatggaggttgcagtgagccgagatcatgccactgcactccagcctgggcaacaagagcgaaactctgtctcaaaaaaaaaacaacaacaacaaagaaaaaacaaaacgaaacagcaggaacccgccaagaacagccttgaaggaagggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaaggtgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaag

SEQ ID NO: 38 - DNA, 1896 bp, Homo sapiens
atcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatgcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccggcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacgcctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatctaacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaac

SEQ ID NO: 39 - DNA, 1733 bp, Homo sapiens
agaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgtttgcccggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtgagacgctggggagtgaggtcagggtctccagaccacagctgggcagaaagctctgggtgggtgtgcgacagcccccaccaggccatctctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaac

SEQ ID NO: 40 - DNA, 2423 bp, Homo sapiens
cccgagcgctccagaaagctgcggcgcgagtccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccttgcccgggtctcagggcgcctggctgaagtgagcatggcttcagtggcctgggccgtcctcaaggtgctgctgcttctccccactcagacttggagccccgtaggagcaggaaatccacctgactgtgatgctccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattccgacacccggaagatcgcgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaaagtggttcagggagtttcatcctctttcttaaggatggcaagctcaaactgagtctcttccaggcgggacagtcactaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggagctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagcgggcacccgcgctcggctgtgtccttcgcgtacgcagcgggcgcggggcagctgcgggccgcggtgaacctggcggagcgctgcgagcagcggctggctctgcgctgcgggacagcgcggcgcccggactcacgaggactagtgacacaatagtcctgtcccaaaaggagcacctcccagtcactcagattgtgatgacagacgcaggccaaccacattccgaagcagattatacactggggccactgctctgctgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaggctttaactc

SEQ ID NO: 41 - DNA, 1674 bp, Homo sapiens
ggcctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttg

SEQ ID NO: 42 - DNA, 2299 bp, Homo sapiens
caagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaactt

SEQ ID NO: 43 - DNA, 2527 bp, Homo sapiens
caaaacaaaagctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaaggtaatttagatgtatctgtacatatttatgtatagatacacacacacatatgtatacagatgaagagcgttgagaagaggatgctagaggaatgtgcccacacacatctcagcagcatggccaaaatcagaaagatgtcactttgatccagttcttgtttaccttatcctgctgtggcgctgattttgtcgtggatcattaacacttgacactcacatgagaacaagactcctgctgcgtccctggagtgtcactaagcaaatctccatgctcacgacagcagcctgtgttgggccccaccatgttgtgaggacacatggcagcagctggggcccttcctgctcagaggagccctggactcttggtgctgcacaaggccatggtgtggactaggaggaggtctcacccaagggaggtagccagtcctgttctctccttcctcctcttgtctgactttcttttccccatcctcctcggttcctctagaacagagaatcatttcttatttcttgaggaaagatctgatagtgaggagcttcaagtttctgtcattacagaaccctgaaaagaattaaagtgagagagcaaagtgggagcatgaagtgaaaatgctaacactggagcaacagtgatggggtggggagtgtgtgtacttcggagtttaaggcacttagtagtaggaaggaggaaacagatgtgggtgagacctacagtatgactctggctatagaaaaaggtatataaagaactacacaaactggtaatgttgaagctttgaagaactttggagagttgaagcctagaaagggaaattcacatgtatttcactctgacaccaggtgtttgttccctttctacaaatggggaaactgaatttcaggttaattgtccaaggacaaaagctattgagtagaaaggctgacacttcattccatctgcctgacaacttgaaggcacccagatcatctgactccatggagcctgtgtgtcctgtgggatgggcacaaagagtgggccaggaggtggggctctgggcccctgaacccctttttcatctaaaactaaaatgttttccatgttacttctttttttttttttttttggagatggagtctcgctctgttgcccaggctggagtacagtggcgcaacctcggctcactgcaacctccgcctcctgggttcaagcaattctcctgcctcagcctctcgagttgctgggactgcaggcatgcactgccacgcctggctatttttctgtattttagtagagacggtttcaccatgttgcacagggtggtcttgaactcctgacctcatgatctgcccgccttggcctaccaaagtgctgggattgcaggtgtgagctaccgtgtctggcctccatgttacttctacatgagaattgatctggggaggaagaagggttctcaggcttgggcaaccactgatatagttcagctctctaatttcactgatgtgaggaaaggattcagagaattcaagtgacttcttcacagctgcagaatggcagggctaagatagatacattatacccagcaccctccccacaccactctgctgtcccctggatccagggcctttatgctggcagctcctctgttgcttctctggagtggtgtggacactggccacctactgagaagtgtttttttaaaaaatgtgtgtgtgtgtgtgtgtgtgtgtgtatagtatttttaaaaaataaaggtcttagatatcagcttcagagatgtaactgtctttcataatataagtgatgtttgccaggaatattatcctaaatttgttagacatatttctgacatatctgtgatgatagtttgaaaattagtatgtattatttgttgccttttatgccattgtgtccttttcttgatgttttcaaagctggctgaatcctacacaatatgttacactcctaatctgcattttttaaatgcataggccgtttaacttagcacagactattggcctctgcttgaagaatagtatacctataaactggaagcattatcatcacttactcattataacccatcctgtctgttctgtacagtatagttggacccagatttttaccctatgaatttggttagcacaaatgggggaaagtatgaaatgccaaggaaaattgaaattcatgtaggagatgagtagaggaatgttcaggagttcaagcagaacaagaggaacccaactataccgtttctgatctaaatggtatggtggggaaaaaccatcagatcaacagaaaggacataatttttaaataaaagta

SEQ ID NO: 44 - DNA, 2854 bp, Homo sapiens
cattttagatacaacatactgcacacgctcccttaacgtgtgtttacgcgtgggtggtgtatccttccagacgtcttcctcacatctatacataatatgcatagataaaacatttaccaccaaaacccatagtgttatgtacatatttgtctggctgtgtaactttaaataacatacaaatgtatagaacagaagcttgccctctttctgaaatatctaacgtgggatttcaggctttctgatgagacctctgtagaggtcagtgttttgccaccagaggtccttcagcctccatctgttctcccacctacccacattctggcccctggcaattcacagggagtttaggaagtagacaccagggccctatttcctggagaccagcctggtggccgatgtcatagagtgcggtgggcctgggccggccctgctctgggcccgtgacctgcgtgtctgactcgggtccagctgttcttcctgccagagcctcttcctgtgaggcgggggtaacacaaccttctgtggtggctgtgggattaatccgtatggctgcattgtgagtaaagcctggtggaaatctctgtctccactgctatccttttcctgctgttcaccttggctccctcgacacttaatccccctccacatgtgtctggagcgggcagagcgggggcagttgatagaaagggggccgggtagtgccaaggctgttactttcccccactgcctcccttggctaacttgaagtctgaccctttataccagaactgtaagacagtgtgtcagaatggattcagttgcagagcaggaagcctggatcccagcgccggacggaaatgagaggtcgatggtgcaggctggtgtgggggttcctccaccgtcagggcccaggctccttctcaggtctcagtctcactcttcttagcacgaggtcaggtctcattccttggctgcgggagctccagccagcacacgttttaggaagaaggaggaaggaagaaggtaaagggtggatggcagctgcctcctcctctcttggaagctcacagagcgctgggtcacaattccctgggtagaactggatcacacaggcacccctgtcagcaaaagaggctggaaaaagtatttctgaagctgaatcaaattaagattcctgttactaagaagggagtgattgtatgggcgactacagggaccacggccatacacggtgcctggaagaccaagcttgtgacagtgacgaggatttggagagggcagggtgatggggagctttggggggagtgcattaggaaccctgacctggagaggggcagaatgaaacctgcgggcccctaaccctagtgggttgtttgagaaacctgtcctactgtggcagggggctgagtcttctcagggtcatgcatgaaaactgaaattcctgaaggccacacacagccccggaagtgctgactgacaagggcacatgccagtgatgcagttttcttttttgtcttcacttttgttgttccgccgtcttcaacacatggctcccagctcacagcaaatgctgccctggttcagctaccaggaagcaggagaggggaagggagggcaagcctcattctttatggaacaaaagcagtgggcagacagccttccctcacgttccactcactggaatgtggtctggctgccttccctgcaggaggtgggatgcaccctcagtgcagcagccctgccccagccaaaaacgtctcagcacagctgtaagaagaggaagatggctagagacaggcagccttccctgcaagtgcaatgaggcaagcctgccaaaagcctcctttggaaatactgtttgattacttttcagagtttctatttaggaaaagggcaaaacctttcaggatcaggagtaggtgagcggcgatcaggcctcactcttcaccgagggccttccctgaggaggggcctgcaggacgctggcagcggaatggggctgtgtggctgctagattaggtcatggcagggagacagcctcttcctggttcttgctagaacaggcacacttggggccttgagctccagggagttcatggaagacatctgactaccctgagccccttgctggagggttctggggagtggcccacggccaccgtcacccatggccaccgtcacccacaggggccgtgaggacatccctggccagcatctaacacaaccacatgggatgccctaagcaactactgcccagccgagggctgcctgaatttctgactcacaaatggtgggcaatgtgaaacgggtattttaagctgctgagttctgcgggagtttgctgagcaacagtagaaaccagaactctcggatactgtgttctgtccttgaaacggtggaagattttatgtgaccagaatggaatgtttgaacaaatattttgagaatagaattttaaaacatttactcatcagcatccaagggtggggagcagtgtcatctaggagactggttctattatttacgtagatgttcttgaattaaaggatgggaatattttttccttccaaaactttttttcaattttatattctgtttttcaagtttttattatgaaaatattcaaactcacagggaagttgaaagactaatacaaagaagaaccatactctttccactgacatgatccaacgaggaatattttgccacacggcaaatatataccgtataattttctgtaccacttgatagaaaggtaaagaatgaatattgttttttaaataacttttttcgtatataagtaatatgtgcttatcgtgtaactacctaaaaacattgaaaaataaaaggaaaataaaattcatacataaccgcc

SEQ ID NO: 45 - DNA, 2313 bp, Homo sapiens
tctctattcacacctcacttcctgcaacaggagatgggtcagctcctgtgatggcagtcgttcggctccttgctgaaataaggacaagagcatgcctggtcatggcccagcttttagaagacagcttattttgtgaagaattcatacaacaatgtccagcagctgttgaagttcttaacctagtagcccaggaatgtagtgctggagagcgacttgcagttgtggaggtacagtgtgaacggctgaggatgctctaccgggactgtgctcggcccccaccacctcctttgcaggctgaccgaagacagcccaaagagattacttggagcccctcgcgagtgtttccgcctgttcgagcctgcatgttctcatctcaccttacctcagtcaccttcctggctgaccccagcgctgggggaggcctgccccggggcacttttatctatgccacttcaccactgccagttcaggccccgtctttttactgggaaattgaaatcgtttcctatggagacaccgatgatgacaccggacccatagtttcctttggcttcattacagaagcagagaagcgagatggggcttggactaatccagtgggcacttgtcttttccataacaacggccgagccgtgcactataatggctccagtttgttacagtggaagagcgttcgcttagacgtgactctctcccccggtgacgtggcaggaattggctgggagagaactgaggggactccacctcctccgggacagccagccaagggccgggtgtacttcacatactgcgggcagcgcctctcaccatatcttgaagacgtctctggtggcatgtggccagtggttcacattcagaaaaagaacaccaaaacccgagctaactttggctcccggccgtttgcctacgcggaagggcaggcccaccgcaatgctgctgacctgtgcactgacctagcagaagagatcagcgctaactttgaggccctgcctttcgccatggcatctgacagtgacaatgatgctggcaccagtattgcatcagacccaggcactcatgggccaccatgccggattgctgccgtggccaccgctcagcaacaatatgatagtgacacctcctgtcattataaagtcgagctcagctatgagaatttcatcacctctggcccagaccctcacccgcctcccattgcagatgatgaaagcgatgatgatgacgatgatgacatccctcaggaggaccactacgccctgctggtgaaagcatgggagaccaaggtttttcctaccatccgaagacgcttccgcaatgaagcagagcggaaatcgggcctggaccagataaagggggccttacaactaggtatggtggatattgcccgacagacggttgaatttctctacgaagagaatggtggcatcccaagagacctttatcttcccaccattgaagacattaaagacgaagcaaacaagttcacaattgataaagttcgaaaaggtctcacagtagtaacccgctctccagacagcaataatgtagccagcagtgctgttggaactgctctgccaaaatttgccatccgagggatgctgaaaacctttgggcttcatggagtcgtcttagatgttgattcagtgagtgaacagccattctgattaataagctattttatatatactgaggctgtcatacccagattcccaggtaccttaaaaagtgattatacagatgagtttctcttcaaatcagggacgaagacacaaagcaaaaatgctctaatgccaattgacttgcctgagctttcctcagggactcagatcagggctggcagtagatggtaggctctccagtctcaaagctgtggccgccttcagaccacaccacctctaccattattttctgtccgacatgttcaaactgttcctgcattatatctacccaagttcccagggaaaagtccccattgtccttgatgaatggatgatctgtcattgccatgatggtcatacagacacaaatcaaagaaataggctgggcgtggggctcacacctgtaatcccagcactttgggaggccgaggaaggaggattacctgagcccaggagttcgagaccagcctgggcaacatggcgagaccctgtctctacaaaaaattagctagtcatggtgggcatatctgtagtcccagctatgtgggaggctaaggtgggaggatcgtttcagcctgggaggtcaaggctgcagtgagctgtgatggcgtcagtgttctccagcctgggcaacagagtgagtccctgtctccaaagg

SEQ ID NO: 46 - DNA, 2926 bp, Homo sapiens
aataagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttccttttttttcccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtgcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagaggctgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataattt

SEQ ID NO: 47 - DNA, 2261 bp, Homo sapiens
ccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgtgtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaat

SEQ ID NO: 48 - DNA, 2339 bp, Homo sapiens
catagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatctttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcgtgaatccatctctgattgaagatgaactgatgctggcaccaggttttgctgccccaccctacctagattatgcaggctaccaccagtacatagaggagatgcttcctccagaaagcccggcactgtatggcctccacccaaatgctgaaatagaattccgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctctccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctc

SEQ ID NO: 49 - DNA, 2846 bp, Homo sapiens
atcaaaaagcacaccttgcatgtcattataggcttcatactggagagaaaccttacaagtgtaatgagtgtggcaagaccttcagtcagaagtcatcccttgtgggccatcgtagacttcataccggagaaaaaccttacaactgtcatgagtgtggcaagacctttgctcgaaattcatcccttctaattcataaggcaattcatactggagagaaaccttacaagtgtaatgaatgtggcaaggtttttaatcaacagtcaaaccttgcacaacatcagagagttcatactggagagaaaccttacaggtgtaatgagtgtggcaagaccttcagtcatatgtcatcctttgtataccattatagacttcatagtggagagaaaccttacaagtgcaatgagtgtggcaagaccttcagtcatatgtcatcctttgtatgccatcatagacttcatactggagaaaatccttataagtgcaatgagtgtggcaaagcctttagtgggcagtcatcacttattcatcatcaagcaatccatggtatagggaaactttacaaatgtaatgattctcacaaagtcctcagtaatgctacaagcattgcaaatcattagagaatccataatgaagagagatcttacaagtgtagtaaatgtggcagatatttcagacattgttcatagcttgcagttcatcagtgaactcatactggaaagaaacgttacaaatgtcatgattgcagcaaggtcttcagtcaagcttcatcttatgcaaaacacaggagaattcatatgggagagaacctcacaactgtgataattgtggcagtcatttttttttcttttttcagatgaagtcttactcttttgtccaggctggggtgcagtggcgtgatctcggctcacggcaacctccacctcccaggttcatacgattctccttcctagcctcctgagtagctgggactacaagcatgctccaccaagcctggctaatttttgtgtttttagtggagacagggtttcaccatgttggcctggttgctctcaactcttgatcttgtgatccgcctgcctcggcctcccaaagtgctggtattacaggcatgagccaccacgcccagtgtggcaatgtctttactttacattcacaccgcattagacatcagggaatctatactggacagaaatcttacaaatggaataggtgtggcaatgtctttagtctgaggtcactccttgcagaacagtagaaaattcatttttgagataattgtcccaaatacaatgactatagaaaatgacaaactttaattgacattagagtcaattctgcattgactagagtttgagttgacttaacattgagttcaagcattaattgacataaaaagtgtttacgtcaagaagaatgggcagggtgcagttgctcacacctataatcccagcactttgggaggccaaggcaggcagatcacttgaggtcagcagtttgagaccagctgggccaacagacctgaaccagtttgcccagcctgttttttctttccttctttctttcttttcttttctttctttcttttttttttttttttttgagacagagtctttctcttgtcgcccaagctggcgtgcaatggcacaatcttggttcactgcaacctccacctcctgcattcaagcaattctcttttctaagcctcccaagtagctgggatttcagatgtgtgccaccacaccacatagtccctctccacagagatggttgagaaggctgatggaaaagccagatacttgttctacagctttccctgacactagtatatcatccacatactggagcatagatatacactttgggatgctcatcttttctaacacctcctcaagaatttggccaaacaagttaggagaatctgtaaatccttggggtaagactgtccagcagtattgttgttttcacccagagtgagaatcttcccattcaaaagtgaatatatcctgactatcttcagctaaaggacatgcccagaaggcatctttcaggtctatttctgtaaaccactgatggtcatatggaattttgctgagaatagtatatggattgggaacaacaggatgagtggtttgaacagtttgactaatggcttgaagatcttctacaagtcagtatcaccaatctgactactttacaagtaatattggagtagtatagggagacatgcacagttcaagtagcccatctcagataaggctctcaattagaggttttaaacctaatctaccttctaagggaattggatattggtttcttttcactgtttccctgggagtttttaactttatgtgaattggaggaacttgtagcttccttcaatttccctcccttgaccactcattagcattgatgtagctttcttctgctgtagtaaacaggtttaatgaagtgaagaatccttctgggcttacacgcaagcctatacctaactttgccattaggccacttcctaacaagtttgtcccagccttaggaagtagcaaaaatttaacattggttgatcgggtttcaaatctgacttctgttttttctgagactttggctttaaatccttcccctttgactcctaaaacttgaagttcttctaataaacaatttatattagagggcacaaaacaaacagaggagtgggaagctcctgagtctattagaaaagtaataagttcggctgggtgccatggctcacacctgtagtcccagcactttgggaggccaaggtgggcggatcacctgaggtcgagagttcgagaccagcctgacccacatggagaaaccccatctttact

SEQ ID NO: 50 - DNA, 3112 bp, Homo sapiens
cgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcgtggagatgttatcgtcattggcctggagaaggattctgaagcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaag

SEQ ID NO: 51 - DNA, 2624 bp, Homo sapiens
gcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggcccctgccgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgatcgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacgg

SEQ ID NO: 52 - DNA, 2400 bp, Homo sapiens
aattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctacatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatttggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttgg

SEQ ID NO: 53 - DNA, 2624 bp, Homo sapiens
tccgtccaccttccggaagtcagggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggaaagattctgaagcttggcggagaggggtgtgtgagtggacaccagtgaagtaacggtttttgtgttacgatgatttctgttttcctctgctgccctgtaatggcaggaactcggatagtctggtcttcagaccaggaggactcccaggagagaacggagagccagtgtgctgtgtgtcacggtccctggatgaacgtttgtggaactggattgaattaaacaagacgtgcaaagcaagtggttcacgagatatttacggagcatccccagctgctggatgctgggacccaccagtgggcaagagggccgtgcccaccccttcctggaagagacactcactcagtaaatgcagagattcagtgttggggtaaccccagcacacagccctgagggaggaagcccagtgatttgatcggatttgcttttctcttctgcctcggattctgtccaacccctggaaggacctctgaggtgtcccgtggctggttctaggccccattcaagcctcctcctccaggaagccttcccagtcctgggcatctgtagccagctcggtgtttctcacctggggcctgggacgtctcccattctgaactgccgtgttttgggtttactgttctctggcttttggtcccagccggacggtggcctcttgtgttcagggacaaggcaaggagcatccatgcacccccacagtacccaggctgggtctgtgcccgccaggcccccggcaaagcttggatgatccgggctgggctgttctcctgctgctctcctgctgctggcctcgctgtatcagctgatggccatcgcgcctcctgcacccgtcatcccgccctgcacgcccccgccacgtggatgagctccctggggagttaatggctaatggagtctccgctctctcttgtcaaatgcagccatcatccgctggtgctttaagggactctctcccgtccccaccctattctcaggtggctcctaccgacaccacctaatggtgaaccccaacacgaggacacaggcagtgccctctcaggaccactgtgggtgccaccaggcacgacttcctaaacacccacagagcaaaaacctggaaattcagccgaggcactgggaccccaacctctcccagagtggccccagctccacggcgtctgcatggctctggccgtgagcagagcagccccgacctccgtcctgacccagggcgccggagcgccactgcggatctcaccaccacacaagccagacctgctaggaagcccttcccggccaccagctctcgggcgatgcacacaacagggccttttgaattccctaaggttaaggttccccttgagtctcctgggctacaagcaaatcccccgaggggagaagtccaggctgacacagcctcctgcacccctgccttgggaggccacacctcgtttgcctctagaaccgacgactggggagcactgtttgcagagttctctctctctgggtaagttccggagccacatctcactggatccaccacggcctgggtggacggctctcgtgtgtttatagctgggtccctcgcttgggagctgcctccgggtgggcggcctctccagcctgtttgagtgctccacccggagcaggaagagggccgtgtgctctgggcagtggttccttgggcactgcatggtccttgcttccctccagggcccaccttccctggccgctgcatcccagccgagggcaggccccttttgccagctgaaggcagaaaggccggcagccctggggtggcggcgggcagagaaaccccccggagtggtctccgttcttctaaaagtgatgttgacccccgtgtcgcaggcagctggcagggtggcagttcgatctgtcgttacgggcttgcaccactgcggtctcccacccagggagcagctctgtccaaccacagcgagcctccagctcctaccctctgcctgggctggggcagagcctggggtctgggtgggagaagcgtgactctgggatgagaccttacaaagcaggttcctcctgggagtcagcccgggtctaaacgcagctgggcatgaaggggtgccatcggatgtcgagttaggaggacgagagacctccagccccggcacccgcatgtctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgaccccccggggggactgcggcccccagaaaggctgcactctgggagcaaagtggcctgaaaccagagaaaagaacgccgggggatttggcttaaactcgttaaacccaatgaaccctcttgccgaacgat

SEQ ID NO: 54 - DNA, 2479 bp, Homo sapiens
actcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctcctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatc

SEQ ID NO: 55 - DNA, 2458 bp, Homo sapiens
ctctgctctggacttgggaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaactcaaccttcctgagtccacacatgttgaatttgtaatgttctcgacagacgtgtcacactgtgttaaagacagacttccgaagtgtgtttctgcatttgcaaatactgaaggaggatatgtattttttggtgtgcatgatgagacttgtcaagtgattggatgtgaaaaagagaaaatagaccttacgagcttgagggcttctattgatggctgtattaagaagctacctgtccatcatttctgcacacagaggcctgagataaaatatgtccttaacttccttgaagtgcatgataagggggccctccgtggatatgtctgtgcaatcaaggtggagaaattctgctgtgcggtgtttgccaaagtgcctagttcctggcaggtgaaggacaaccgtgtgagacaattgcccacaagagaatggactgcttggatgatggaagctgacccagacctttccaggtgtcctgagatggttctccagttgagtttgtcatctgccacgccccgcagcaagcctgtgtgcattcataagaattcggaatgtctgaaagagcagcagaaacgctactttccagtattttcagacagagtggtatatactccagaaagcctctacaaggaactcttctcacaacataaaggactcagagacttaataaatacagaaatgcgccctttctctcaaggaatattgattttttctcaaagctgggctgtggatttaggtctgcaagagaagcagggagtcatctgtgatgctcttctaatttcccagaacaacacccctattctctacaccatcttcagcaagtgggatgcggggtgcaagggctattctatgatagttgcctattctttgaagcagaagctggtgaacaaaggcggctacactgggaggttatgcatcacccccttggtctgtgtgctgaattctgatagaaaagcacagagcgtttacagttcgtatttacaaatttaccctgaatcctataacttcatgaccccccagcacatggaagccctgttacagtccctcgtgatagtcttgcttgggttcaaatccttcttaagtgaagagctgggctctgaggttttgaacctactgacaaataaacagtatgagttgctttcaaagaaccttcgcaagaccagagagttgtttgttcatggcttacctggatcagggaagactatcttggctcttaggatcatggagaagatcaggaatgtgtttcactgtgaaccggctaacattctctacatctgtgaaaaccagcccctgaagaagttggtgagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtggcctcccccctccctcagaccagtatccaagagaagagatcaacagagtggtccgcaatgcaggtccaatagctaattacctacaacaagtaatgcaggaagcccgacaaaatcctccacctaacctcccccctgggtccctggtgatgctctatgaacctaaatgggctcaaggtgtcccaggcaacttagagattattgaagacttgaacttggaggagatactgatctatgtagcgaataaatgccgttttctcttgcgg

SEQ ID NO: 56 - DNA, 2096 bp, Homo sapiens
acagcgcaagccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctagaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcatcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcggggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactg

SEQ ID NO: 57 - DNA, 2187 bp, Homo sapiens
aatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccacctgagtagcgtgagccagatgacgccacagagacccgcctcttccctgaacgcgggtcggtgtggaatcagtgactgctgactcagggagctccttggccccgtgggcactgtgccagggctggggccttctgctgctgccacacccagctcaggcctgggccagcccctgcccccagcccactgagggggtgggcttactccctgggcagttttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggctttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgct

SEQ ID NO: 58 - DNA, 2011 bp, Homo sapiens
actcattgtgtctgtgtcgaggcgtcgggagggcctaagtccgtgtgcggtgcccttcggccggcctgagccccagagtcagctcccctttctcgcccagcgcccccaggccgctcccggggctcacggagtctctctctgtcacccaggctggagtgcagtggcgcgttctcagctcgctgcaccctccacctcccaggttcaagtgattctcctgcctcagcctcccgagtagctgagattacaggaatagtaaagaaacacatcataaaacctcccaggacataaaggctgcacaggagaaggatggtatcgtaatagtgaaggtggaagaggaagatgaggaagaccacatgtgggggcaggattccaccctacaggtcacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagggaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctgggggg

SEQ ID NO: 59 - DNA, 1864 bp, Homo sapiens
tttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagagtctcactctatcgcccaggctggagtgcaatggtgccatctcagctcactgcaacctccccttcccaagttcaagcaattttcatgccgcagcctcctagctgggattacagggtcccactctgttgccgaagctggagtgcagtggcacgaacatgtctcactgcagcctcaacctcctgggctcaagctttcctcctgcctcagcctcctgtgtagctgggaccacaagcactcgtcaccacacctggataattttttgatgttttgtagagacagtgcttcagtttgttgcctgtgctggtcttgaactcctggcctcaagcaatccttctgctttggcctcccagattgctgagattacaggcatgagccactgcgcccggtccagatctttttttttttgagacagagtctcgctctgttgcccaggctagagtgccagtggcacaatctcagctgactgcaacctctgcctcccagttcaagcagttctcctgcctcagcctcacgaatagctgggattgcaggcatgcactaccacaccgggctaatttttgtatttttattagagacagggttttgccatgttgccccagctggtcttgaactcctggtctcaagtgatctgcccacctcggcctcccaaagtgctgggattacaagtgtgagccaccgtgcccggcgcactcacacgtttctaatgtctctcgccttggcctcccaaagtgtttggattacaggcgtgagcttctgtgctggccaaaacagaatgttggagacacacactgaatttacttggaaggctgattgttttcccacgccctccctaggagggtgagctgggtgttgggaccttaactctgcccataagatgttcaggccaggagagatgccctttaccccttgggttacaagggtttccactccctttctgcttgattgaggcttgccctcagttctttgtatccctgctctgctctgcttgtttcaaacaacacatttttgcactgtgtcatgaacagctcatcttcagagagtctgtttttgctggtgttttccgggatctgcatgtgcctcttcccatgtaactttggtaggccttgtgcaggtcttggagtttccagtgtctttttgtcttctagtttcgttgaatatgggatttctgcctcattcccccgctcaccaccatatctccctatcactttgcataatttctaggaggaggaaggggacaattcagtcaaatattgccacagttcttatactataatcatatcgctttgtaatataaatttctcccactttttccattataagattaaaaatagctcacaccaaaatcccatcgcttgaacccagaaggcagagattgtagtgtgttgagattacaccacggaactccagcctggacagagacagagccagaccctgtccc

SEQ ID NO: 60 - DNA, 2034 bp, Homo sapiens
gaatttccagcaggcaaggcagtggccgctttgactgcttgcttcggagatccgagacgacggagaaggcactcttatttaccgaccaagaaagctcctcccccgtcctccgttagctaattaaaacatttttcagggacgtagccatccagagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtgttggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgggaggccgaggtgggtggatcatctgaggtcgggaattcgggaccggcctggccaacgtggtggggccctgtctctagtaaaaatcc

SEQ ID NO: 61 - DNA, 1593 bp, Homo sapiens
ctggaagggctggggcggcgcttggggcggcccagccgccgcctcccgttctcccctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgaccgaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggacgcccaggagtacccatgcacagcagctgtggggtgtgggcatcttcaggtggtgttctggtaaaatcgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgc

SEQ ID NO: 62 - DNA, 1782 bp, Homo sapiens
actcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtaaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttg

SEQ ID NO: 63 - DNA, 2094 bp, Homo sapiens
gcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagaagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacactgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggggagcattcctagacccctgggtgcttgtctgcacagagctctggtctgtgccaccttggccaggctggctgtgggagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 64 - DNA, 1912 bp, Homo sapiens
aagatctctctggaccagctcgggtgcagggcctctgcgggagccctcctagacctctgcggcttctcctctaacatggccgactcggaaaaccaggggcctgcggagcctagccaggcggcggcagcggcggaggcagcggcggaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtagtgttaataaaacagtattttcaaaaaat

SEQ ID NO: 65 - DNA, 1644 bp, Homo sapiens
acttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtgcacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgggcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccactaccc

SEQ ID NO: 66 - DNA, 1894 bp, Homo sapiens
atgagttcaagcagttctcctgcctcatcctcccaaagtattgggattacaggcatgagccgtgacacatggtgctgtacccactttttgttaatgatatttatagaggctatagcacctcaaaaagccctgggatagtctgggaagccaaccctaagaaagtggtgcaggagctggtcctttactttgagaagtttggagaggaaggaggacttcccaggtttggtggtcaaagcctgggcagctggtgtagctgtggcatcttgtgtaagtgtgggccggctgctgagtcagcatgtcacactagacctccagacagccctgccaggggagtcaactgaggctcaggggtgacacagctggtttgcagtcgcacatgggagccagaatgagtgtggaccagccctgctcacaggccaaagtggggcccatgggggtgggcctgttgctgggaccccctccccaggaggtgtgacccttccccatctctgcccagactgcatcactgtgaccagtgctgaggatggcggggccgagaccacacggtacctgatcctacagggcccagatgatggtaaggccccaggtgccagaatcggggaggcctgcagtgggcagggggataggtgaggacaggttctgccgcggattccgtctgtggccctggctgggtatccactgctctgggtctcagttttcctactgacgggttggcctctggtggggaatttggttctgcactccctgggcctgcctgggaggggtagctatagctcatggccagtgctgccctccatttaaccaccctccaattgcctcacccatccccaggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagacccaagaggaagagggaccagaggaggaggacgatgatgacattgtagacgctggagccattgatgacctggagggtaggccaccatggtttctaggcctgccatccctatgcccatctagacatactcactgagctttcacttggagggccagtaaagaggaattggcacagacacatccacaggtccctccagtataagacagaggaggttgtgctctgggaccaggacttctgtgtgcagttgtgcagggtgcacactggaaaagagcacagggggccctgttcacatttgccccacagaaatagaatacaagtaaaggtgcgagaggaggtcctcgccctgttgctcagactggagtgtagcatcatgatcgttgctcactgttaccttgaattcctgagttcaagccatcttcccatctcagcctcccgagtagctggggctacaggtgcctgccagcatgcctggctaattttttaatttttgtagaaacgggttctcccagcctggacaacatggcaaaaccccatctctatgaaaaatacaaaaattagcttgttgtggtatgtgtctgtaatctcaactacttgggaggatcacttgagcccagaaggtcaaggctgcagtgaactgtaattgtgccactgcactccagcctgggcaacagagcgagaccctgtctcaaaaaaaaaaaaaaaag

SEQ ID NO: 67 - DNA, 2318 bp, Homo sapiens
ctacagctcctcaactccagtgactttcattctccactacactcagcaacccatttccatcattcggagctattccacctctgaaagctcacatcccagcatcccactcggtgaccaccacttctcgtccttctagttctcacccttgcatcccatgacatctgctctttgcctgcatccagatctccatccctccatttcctgcatcccttgaccttgcttcctccctatcctgtctgtggttgctcagttcggccactcatcatcagcaccttcagctttgcccatcctttggccatatctgacttgcaaacccctgagctggaattgatcctccccattctgcttcccctgctcctcagcccgggtagctgagctctgctggagaaaaccacatagccctgcggattgctgccactgcagagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaattaagtgtcagg

SEQ ID NO: 68 - DNA, 2156 bp, Homo sapiens
gtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggaatagccaggccagaagaaggaaggcctgtggtgagtgggacaggaaatgacatcaccaccccaccgaacaaggagctcccaccaagcccagagaagaaaacaaaggtaggtgccagaatggtggttatcttctactgccataatttttaaacggagtatcttctgctgttattgcttgaatcacgaatgaaatttcttttttctgagccgttattgtccttcctcatgtttggacatgcttagaaaatatcttgtattctcatttaccacagtggcctaaaccaactttaaaatctcagcctttgaccctattatcttatatatctgtaaaaaatgttctgtagaggccgggcatggtggctcatgcctgtaatctcagcactttgggaggccaaggcgggcggatcacatcaggagatggagaccatcctgaccaacatggtgaaatcccatctctactaaaaatactaaaattaactgggcgtggtgatgcatgcctgtaatcccagctactcgggaggctgaggcaggaggattgcttgaaccaaggagttggaggttgcggtgagccgagatcatgccactgcactgggctccatctc

SEQ ID NO: 69 - DNA, 1452 bp, Homo sapiens
cttttttcctctcccaggtgcgcttccctgcttgatctgtgtaccctgctctttctccttcattccgcagcctcctttgccctgtgacctgcaggtactggacggtccctagagaggataccgggacgctcctgaagccgcgagatgagccaccatcactcatgttcttgaatgggaactgcctggagaccctgaagaagaaggagcctgaaggaggaaggaggaggctgagccatcccgggaacatgggctggatgaggccaagccaggagacgacaccaccagatagaagtcaccattcaggatttggacttttctgtggagatcctggccccgagatcgaacccttctccctgtgggtgttcccgcaggagatggtgctggagatccaccagctgttcatggaccatgaatacccatgtcaccacatcacttctcactgcacctgggtggcagcacactggaccacgtctcagagctgcgcagcatggcagggctgcaggcgggcttgctgctccacgtggtggaagagccctgcacaatgcacaaggcccacggtgatgagtgccacatttgagactgctcaggagcctggacccagctgatgcagctccttgtccttcctgagcgtcttcactgacagtggcctgagagacggcaggagcagaaagacttggagatggaccccaccgactgcacaccacccaagtacatcctgctagggaccctggaacagccactgtgtcccctgcaaccccagaacggtgactaaaagcccctgaaagtgctcaccgtgagcggctggtacctgtcccctgggaactgcaagatgcacaggaccttgtgtacctgtttgtgatcacagccgaggaccagcgaggtagcattaccacatccacacagggcttttaccataaccgccccagtactggaacgaggagctgcagatgatgagggacctacccaacaagaaccaacctgagcagctgcttcaagaaaaagccatgttcaaggtgcctgaatcccctggtaagtgagtgacagcctcacagcctcaggcccacctggctcctgctggaaggttttcttgtgctcgggagagaagtgagggaagccggcagtcccagccctgtcaggtgccctgaaggcccgtcaggtttgccctgcaaggccttctagcattctgcttcctgggagaccatcccccacctttctccggcctctgagactttgagtccttgggaggagaaggccctccttgctatctgggctgagtggccagggccatccagcttcccaccctccactgactgccatggggccctcccctgagcacatggtgcccaactgtagcccttctagggcaggggctcattggcagcacttgcagcttgctggcacttaaaagtcattagtgcggttactgagagaaatgaggaaaaaataattgtt

SEQ ID NO: 70 - DNA, 1975 bp, Homo sapiens
acacataatgatttggagttccatttcttagaaaaaatgaagattgaccccgattctttaagtgctgggagtattaccataataaatggtatcactgcatgataagagcaaatgtgtgattttagtcaacatattttctacatgactaatgagagacttgcagcttggatacacagcagtgtctagagtcagtggctaagccgtggtaggtctctatgaagtggggaaatatttctgaccaaccccagggggatgtttgcagtgtggagtggaagctgccctgctgtggtttagcactgcaaaaactctcccttacatatgcaatttgcatattcctttatatactgaaaggccacctgaacataggtggtcaaaagaccttttttctaccttccttcttctgttctttccattggatctttgattctgagaagtctgccccatagaaaggaggaggcttaactctaggaatgcttcctgttctccttctctttcgtctttcttctcactcccagccctgaaggcatcacagaggcatcagtgatgctttttttttcctcctccactccagtctgctccgcagaaccccatgtcctcagataaaatgccaccaaaaagtctgaaggtgctttgcaatggaaatggattattgaagacacaaagacccgtagtaaattttacagtttatacttctgtgatgttgttattcttaaaattgacaagaaaaatcaggaaatttacataactcctgtgagtttctaggacaaatgagtttatgactataaaacaccttgtaatctaatttacagaactgtaggtaaatataattgggcactatgattgttgttgtcatcgtctttcttgtgaagagtgataatcctgagaaaatcaaaagctagctctgtgccaagttcaagttgaaagagcaagagaaagccagctgggcggctgcagttcactttatggtgggccccaggaagctgaggcatccagtcacccagctgctgatcggctgagttaggaatcagactcctagcttttgttccagaatcaagacatgccccttgaggctcagccataagagcttcactttgaccctcagagccctgctctttgcctggatggttcacctttgtggacactgtcccagccagccagcctcttcccattgttccttccctagcccctgccctgccctgattggtgaagttgctgccagggaccaggaggccaccctcccaattgtttattataaacagggggagaaaagtggggaaggaaaagtgccagaggagaatctcatatctagctgcccaagccaatccactgaacacccattacatatgctggctaagcgtccattgatctttcccattagaacaatgatagtctccaagtatatatgggttacaggttttggaacacagtgaaagtggataatggtttttatgggaaaatgcattctgagatggaaatcaccaacttagtaacaaacatttaggacttaatgctgtccacaaattgaggactacctttcatttatgcagcagttacaattccatagccagaagtgctgacattccattaaagaagagcaagaagcgatggggaaaacaccctgaaaactacaataatctttgatgccaagagagaggagcagcaaacattataagaataacatacagcaaactttgccaaataatggggagttcctcacacatgaagcttgcttcctgagaaacaacagatccacttaaagactactcttaggaatattttctttggctttgtcaaacattttggacttttctgcaaccatgtcccaataaatgtacctcattaaaaatataaaactagctgggcacagtggctcatgcctgtaatcccagcactttgggatgctgaagtgagaggatcccatgatcccaggagtttaagaccagcctgggcaacatacagaaagccagtctctacc

SEQ ID NO: 71 - DNA, 2108 bp, Homo sapiens
atttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcgcccttcagaccaggactttattagatgatgagaacgacagtctgagatactcggcctttgttttgtttgggcaattggctgcctttgctgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgttttttttttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatcctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccaggtaactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgt

SEQ ID NO: 72 - DNA, 1852 bp, Homo sapiens
acagtctcgagggaagagggtctggtggaaggagatgacgccgtctctcagcgctgaggaaaacagaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttaaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatacttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcggtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttg

SEQ ID NO: 73 - DNA, 2997 bp, Homo sapiens
tcaaagtgctgggattacaggcgtgagccaccgtgcccggccgttacttgtcctcttaagatgtcttgagagcctcatgcgtcccactgtttggtgacaggctacctggctacctctggaagataagccgggactgccccccagcagcccaccctttctccctagtggggcacgggagacgtcccctgctgagtcctcaccctccctgctctcagcacaggatccagtgtgcttttcctcccgcagcactggcttcgggacgttcagagagaacacactgagtgcgcgcagcctcccctgctcccctcacataaccactggggtcccgagagcgaggggcctgtcactccgggtccctgtggtttagggctgtttctgtagcgcctgcgacccccctggttttcactgtgaaggctgcaagggagaaaagaggcccactaggaacattctggggagccaagggtggggtaatgcaccacccggcccctgcgtggcccagatgtgggtggtgcgcttctcatacctggcagattagcctaggtccccggagcaccagcttcatcctctgtcctctttcctcctgtggcccaagaggagaggtcaggtcagatggctggaggcagcttccagagaggctcggtgtgggtggggccgggaggaacatgcccctggggcgggggctcactctctggcgtggctccacacccaccgtgtgcttgtcgtggagccaggctcggtgcctaccaggcctgagtcaagatgtggcacctggtgctgtgggtgtccccccgctcccgggggtcatgtctgtccttcgcagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccccgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgccgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcggtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggcccggggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttc

SEQ ID NO: 74 - DNA, 2772 bp, Homo sapiens
attctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggaggggatgccccgcaggaacatggtaagtagtgaggcgcatggttgcctcttgagaacggctgtcttttatgctacctacccctgtacaagttatgcgaaggaaaccaagccatctgcatgtttatttcctctgctcataataggaaaatggatgttatggagcttcaagaattgagttacccaccagaaccctaatggtaaagctatgattttaggcatgctgtcaaatccctgctttcagaccctccttaacttcatattgtgagactgctcggtcaagtgccaggagattgtgattgggagagggtaaggcaaacagcgactgccagaaagaccttttgcaggatgtggaggcgtcctcaggagagttatttcgatttattctgaagcctgagttggagcagatccctttcttagcttatatcttcttcttgtaaaagtgcttttcaacctttctctcccgaacatcttccttctccaaagctgggagtcatgttgcctgcagggactctttccttactgggcccaggagttcgaggtgcagtttggcaacctgtgtcctggctgaggaatgcactcacagcacccctttccgagcccacgtgtgggttggatgcatcacgccagtgcagctattgccccgctgccctctctggctcaggggaaagccctgttcatattgctttgcaattccaggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcaggtcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatg

SEQ ID NO: 75 - DNA, 2036 bp, Homo sapiens
atcgaaattagaccagttaataactctacagtggcccctaaatgttcaagtggaagagtcacatgtctctcactttaaatcaaaagccagaagcttagtgaggaaggcatgccaaaagtggatataggccgaaagctaagcgcctctcgcaccgaacagttagctaaattgtaaatgcaaaggaaataaaagtgctaccccactaaacacacaaatagtaagaaggcaaaacagcctttgctgagacagagaaagtttgagtggtctggatagaagatcaaaccagccacaaccttgccttaagccaaagcccaacccagaacaaggctccatctctctccagttctataaaggctgagagggatgaggaagctgcagaagaaaagttgcaaactagcaaactagttgattcatgaagtttaaggaaagctaatcctgtaaaataaaagggttgggggctaatgcagctggtggctttaagttgaacccagtcgcatttatttacccttctgaaaatcctggggtccttaagaaccatgctaattatcatcacaccttatataccaaaaggttaattcagttaagaaacatgaagccggttttgctgcactgagtattattttactgaatttgatggcagtttttacaactcttcatccccctggaatgcctgctgtggtagaggcatctactctgcctgtgctctagaaatggaacaacaaagcctggctgacagcacatctgtacaccatgtatttacaacacggtttactgagtattttaaggccagtgtcaacacgtactgctcagaaaacaaaaattctttcaaaatattactgttctttgaaaatgcacctggtcacccaagagctccgatggagatgtgcaaggagattcgtgttgttttcttgcctgctaagacaatatccatgctacagcccacggatcaaggagtaatttggactttcaagtcttatttaagaaatacattttgggctgggcatggtggctgacacccatcatcccagcactttgggaagccaaggcgggtggatcacctgaggtcaggagttcgagaccagcctgacaagtatggtgaaacccaggctctattaaaaatacaaaaattcgctgggcatggtggcatgtgtctgtggtcccagctacttgggaggctgagacaggagaattgcttgaaccctggaggcggaggttgcatagagcctagatcatgccactgcactccagcctgggcagcagagcgagactctgtctcaaaaaaaggaaaagaaatacataaatacattttgtaatgccatagctaccataggcagtgatgcctccagtggatctgggcaaagtaaattgaaaaccttgtggagaggattcaccattccagatgtcatgaagaacactcatgaatcatgggagaaggtcagaatgttaacattaattaacagtggtttggaagaagttgatttcaaccctcatggatgactttgaaggttttaagacttcagtgaaggaaataactcagatgtggcagaaacagcaagaaaaataggatcagaaatggagcctgaaaatgtggctgaagagctgcaatctcctcatcaaacttgaacagatgtggagctgcttcttaggggtgcgcagagaaagtggtctcttgagatggaatctactcctggtgaaaaggctatgaacactgttgaaatattggcaaagaatttagaatattacataaacttagttgacagtgcaacagcagggtttgaaaggattgattccaatttccaaagaagttctactctgggtataatgctatcagtgtcacatgctgcagggaagtcttttgtaacaaggggagtggtggcaaatttcttgttgtcttactttaagaaattgccccagccaagccaggcgtagtggctcatgcctgtaatcccagaacgtttggaggctgaggcgggtggatcataaggtcagagttcacaaccagcctggccaacatagtgaaaccccgtctctactag

SEQ ID NO: 76 - DNA, 2271 bp, Homo sapiens
agttgaataaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccaggggaagaagaaaacatactctcctcaggccagatttcatagtgaaaatgagaagcagagacaaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 77 - DNA, 2358 bp, Homo sapiens
aagctgacgagaggaaactgctggggagggtgaaatgggtggtgctgacctggtagaaactccacgggcctcaaagcggaacctttcccgaattaaccagcctgtctggcctgtctttggcagctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcaggtgagcacgcccaaccctgaacctccacagcagtccacctcccctgggcagagcagggagctgatgagaaagccggggcctctctccagggaaagggcagatagaagcagagctcaacttctgccctgggccttgaccttggcctcgaccttgcactttgggaaagtcccgcctgccagccagcgtaagccaaaggccggctgcgctctgtctgctggtgtccttgtgtttttccctagagccaggggagttgtgtctgatccacgccctgctcagcacccagccccctgctctgatctgtaacgcttgggcttcccagtggtttcagaaggcagcaggcagggtggcttagtggtgccaggctgaggcgaggcacagcgtgacatctacctgcggggagcatctctcctctcaggcgctggtcctgaggcctcgcgcttctcctgtagctcatttctgtttgtgattggaccggccctctctgcttcccaagtccatgggcccgtcatgggtgggtgccttaatcctttccacctcggcgcgaccggctcccagccttgggccttgcacacagtaggtgctttgctccccatttggaattcaccccatggccaccagggggcgcaagtgccctgcgctgcccctgtgccttctgtgggtcgcagaatcagaaatcttcatctttggggactcatacacgtttttatttataatcgtgataaatcgagagagaccacccaaggcatatctaaattagatgtgagatgagaaggggggcttattcctctttatttttcctctgtgaggattctgcgtaatgccctggttgcatatacttttagtggaattgacctcaaatacatccagagtacacagctcatttcattggctttgaatgtgatcccaatgggtttttgcctgtgagccaggcctagggaactctcaggtctctgctggccctggctctgctgtgtggttcacagagtgagacttgcagccgtcgaccctggcaggctgctccctggttcgggggctcacaggctgtacagtaaaatgctagagcttgggagaccctggggagcctctagtcctaggattgacaactcagagacctgccaccaccagctgggaagcagaggagtctggggtaaggagcaggcagctgctggccagtgccagtgattgcggccacacagaaatgcaggcctgtgtggaaatgcaggccagtgtggaaatgcaggccagtgtggaaatgccgtgtagtacagtagtgcaggtctgggtagaaatgcaggtccatgtttgggaggtcaaggtgggcggatcatgagctcaagagatcgagaccatcttggtcaacatggtgaaacctcgtctctactaaaaatacaaaagtcagctgggcatggtggcacacacctgtagtcccagttagtcaggaggctgaggcaggagaatcacttgaacctgggaggtggaggttgcagtgagccaagatcgcaccactgcactccagcctggcgacagagcgagactcagtctcaacaacaataacaacaacaacaaaagaaatacagatccatgtagaaaggcaggccagggccgggtgtggtggctcatgcctgtaatcccagcactttgggaggccaaagtgggtggatcatgaggtcaggagttcgagaccagcctggtcaacatggtgaactcccgtatctactaaaaatacaaaaattatctgggcgtggtggcacatgcctctagtcccagctactcaggaggctgaggcagaagaattgcttgaacccgggaggcggaggttgcagtgagctgagatcacggcactgtactccagcctgggcgacagagtgagactctgtctc

SEQ ID NO: 78 - DNA, 2278 bp, Homo sapiens
ggctatccagcctccctcggccaaattgctgcggagcccgtcgtcagggggcgccaaggagccagggggaaaaccaagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttggcagaattgtcaaaggaagaattgtgcgccaaaataaaaagcctgaaagaaaaactaacaaacacccggaaagaaaacagccgacttcgacagtctttggtcatgcttcaagtgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaatgcatcaattttcagggaaatctttttgtttgtttatttaccagacatgttctaactttgtattgcccaaagtatattaaatacagatgtgtaatataaagcatcaatatcacctaacacatcgtatataagatataacatgatagatagttggtcgattacattgctatactgcttagttttaactggtttatttttattgtagcagaaatgaactgaaaaaaaatatgggtttgataatcacacacatgaaagtaccattttgtaactcaacaaaagataaaacattcttcatcaaaaggcttctcgcttggtgtcaggttgtcacatgtgaccactgtgcaatgcgaagccatacttcttcagtgcacaaagtcatgtttaaacttggaaaagaggatgctacagtagtttcaaagtttagtgttgtggacccaggaaattttccataagtcttgcttgataacaatgtgattgtacaaaataaatgttcttaaggaaacaacttatgtaacatttgctacctttatgtaaacataaataaatcccatttaaaagat

SEQ ID NO: 79 - DNA, 2048 bp, Homo sapiens
cttttttgcgctggaggagagtgaaagagatgggtgtgtgggagtgggggaagctgagctccaggcagacagcacagagccgccttgtccaacccagccaggtgccatggcaaccaacaaaggccccattgtcccgtgtctgctgggccttcctgaggctctggggtcagagctttggggaagtgttttgtttgtagatttgggatgtggagggggactgggctacaacacccacccaagagtgtcagaatctgacatcccctgagagaccacccaagcccaaccgtccactgtatagatgaggaaactggaacttctagaggggacgagaagaatgaattagcctaacttagtgctccatccatgtgactggggcaggggaggggtcacttttgtcttcctgagggagacaagagatctctcctttcatgagagacttgggcttgaggctgggttggagaggaaagtctaaaatgtgggggcccaattcacccacccccaaactccctcctcatggtctggtgggatttgctttgcagagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctaaaaaaaaaaaaaaaaaaaaaac

SEQ ID NO: 80 - DNA, 2139 bp, Homo sapiens
ggctcctcagagcaagggaggtagtcgggtcgagggaacctggctctgcccaggtgccactgcccaaacccctgggccccatccatggcaagagagaccttccccttcacctcctccatgctgcgctctctccgcctgcagcaggagtggctggaatgggaggaccggcggcgggcggctgcccagcagtgccggagccgcaggtgcccgtcaagtccccgggcccgactcactaggcctcaccgttcctgccgagacccagctgtccaccatgccctcttctccggcaacctgcagcaggtccaagccctgttccaagatgaagaggccgccaacatgattgtggagactgtgagcaaccagctggcctggtcggctgaacaggggttctgggtgctgacccccaagaccaagcagacggcacccctcgccatcgctacagcccgaggctacacagactgtgctcgacacctgatccggcagggagctgagctggatgcccgtgtcgggggtcgcgctgccttgcatgaggcctgtgcccgagcccagtttgactgtgtgcggctgctgctgaccttcggagccaaggctaatgtgctgactgaggagggcacgactcctttgcacctctgcacgatccccgagtccttgcagtgcgccaagttgctgctggaagcaggagcgacggtgaacctggcagcaggcgagagccaggagacgcccctgcacgtggcggcggcgcgcggcctggagcaacatgtggctctgtacctggagcatggcgccgacgtgggcctgcgcaccagccagggcgagactgcgctgaacgcggcgtgcgctggggccgagggcccaggtagctgcaggcgacaccaggctgcggcgcgccggctcctggaggctggagctgatgcccgggcggccgggcgcaagcgccacacgccgctgcacaacgcttgtgccagcggctgcgggggcctggccgagctgctgctgcgttacggggcccgcgctgaggtccccaatggggcgggccacacgcccatggactgtgcgctgcaggccgtccaggacgcccccaactgggagcctgaagtccttttcgccgcactgctggactacggggcgcagccagtgcgccctgagatgctgaaacactgcgccaacttccctcgggccctggaagtcctgcttaatgcctatccttgtgtcccatcctgtgagacctgggtggaggcggtgctcccagagctgtggaaggagcacgaagccttctacagctcggccctgtgcatggtgaaccagccaaggcagctgcagcacctggcccgactagctgtgcgcgctcggttgggaagccgctgccggcagggtgccacccggctgccactgcccccgctcctcagggactacctgctgctgcgtgtggaggggtgcatccagtgaaccccatgtcaggctgtcccatggtgtgttctgcccctcccacctgtccccgcctccaactgcggaggaccagttcctggccctcttttcttttctttttgagacctagtctcactctgttgcccaggctggagtgcagtggcgctatctcggctcactgcaacttctaccacctaggttcaagcgattcttgtgccccaaacttccgagtagctgggactacaggcatgagtcaccacacctggctgattttgtatttttggtggagacggggtctcgccatgttggccaggctggtctcacactgacctcaggtgatccacccgccttggcctcccaaagtgttgggattgcaggcatgagccactgcgcctggttgcctgcccctcttttctgtactccacgtgctgtcctggtccacctcactcctccatgggcttcttgagacacctgctgacctctagccggacctgagcttcagaccctctctccagcaggaagggctgcagactcggcctgttcccagactcggccttcacctcccttctcctcctgtgtttaagtggatggcccctctatccatccaggtcccatgccaagaaccagtgattctagtggcccaccacctccctctcctgccacccttatacctgttcagcctcctaaagaggaacaaactctgtctctgcgtgc

SEQ ID NO: 81 - DNA, 2258 bp, Homo sapiens
gtcggccgcgaaggcgtggcggcccgcggaccggcggaccccgggtcataccagctgtccgggtgcacaggcccaggggccccacgaccgcgggtgtcgggaccgtgggctccactgaggagcccaccgaatccttcggcctggccaggcggggggtcttcttcccagtccgcggaagccaggtccgggagacggcggggctcactgtgccttcggacctacactctgctcgggggccggatttctgcaaagcgtccacttggaaagaagtttcacttgcagggaaggcgggtgtacgcaatgatggtccgtgtgtccgggatgtgaatgccaaccaagactgcgtccgttggtggagtgtgcgcgggtcctccgtgagggtgcttctggcagtcacagttcacgagttagcgagaagatggctgggaggcggcgagcccccgctcccggggcgcgcatttcgaactccataggtctcccgtggagagcagcccagacccggccacactcagtgaggaggaagtgcgcctcctgctggctgcactggtgcaggactatgtgcagatgaaggccagtgagctggagcaggagcaggagacagagctccagatttaatttatgtccttttcttctatcttctttggatggaggctgagtttcagttcttgccggagagtttccagatttctcctcctgatggcctgttctgtggattttggatttgccaaggcagccctcacaatccgagtcctggggctgtctaaggaactatggtgagatagagtgttatgggttgaattttgtccccctcaaaaaggtaccattgtcttctaaaagaacaactgaggagttcaacatgaaggaggaaggatatgtcattctttgcagtgacacaatcagaaaaggtactgctcccccacctaaatatgagggataagtgattttcagaagagacaggagaagaagggacaaatgtcctggtccttgtctccttgtcaacaaaagatgtactggtaccctttgaaaggggacagagaggatgccagctgaactgggagcactaagttctctgctttgtgaaaatgaatctgcaatgaactcctggtctttgtctggatgcccatctttctgcaagttgtcagcagaagcttttcaatgtggctacttggtgagttcacatacagcccaacccatagttctgatggagcctgaaaatcagccctgaaaagttctcctcagaggatgcctctgaagtgagaggcatgaaaaaagaggctaaccttcagagaggcggcatgggtttccggaagttctcccccttcctggctctcagtatcttggtcctgtaccaggcgggcagcctccaggcggcgccattcaggtctgccctggagggcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgcttact

SEQ ID NO: 82 - DNA, 1809 bp, Homo sapiens
gcttgtccggtggctgctgcgctgccgcaacgaatagggtttctggctgcgtaggagggacgggggcgcggagctctgggaaactgcgccaggcgcccgaaaggtgaacacgggagtcgcgcgtctcccccgcagcagcggtaaagcggaagttatgctgcagccggagcccgggcttcctcccggagccgcgtcccggggcccggctgccccgagctgagcggagcatcctttccgggtgaggggaggagaggacttggcgcgttcccctcgctgccccgggagccgcagccgcggtgttcatgccgcggagcagccaggctcctccgacgaaaacctgcatttatttgctggcgggacgtttgccttgaaaatggacaaagacgccgccctccggggtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcctctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattaacaatttctgtgagggaagtatctcggcttctcccttgaattccagaaaatctgatccagttacacccaagtctgaaaagaaaagtaagaacaaacaaagaaacactggagatattcagaagtatttgacaccgaaatctcagtttgggtcagcctcacactctgaagctgtacaagaagtcaggaaagactccgtatctaaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatcaatgcttttctgc

SEQ ID NO: 83 - DNA, 2299 bp, Homo sapiens
ctgttaaacggggatgaggataaactacataggcatgttatgaagacaaaatgaggttatgtctaaaatacttagctgggtgcttgacgcatagtaagtgctgagtcagtaatagggtttttgtttgtttgtttgtttttgtttgtttgttttgagatggagtttcgctcttgttgcccaggctggagtgcagtggcgcgattttggctcacctcagcctccgcctcccgggttcaagcgattctcctgcctcagccttccgggtggctgggattgcgggcgcgcgccaccatgcctggctaattttgtatttttagtagagacggggtttcaccgtgttggtcaggctggtctcgagctctcgacctcaggtgatctgcccacttcggcctcccaaagtgctgggatacgggcgtgagccaccgcacccagcctgtttgattttttgagacagagtctcgctcttgtcgcccaggttggagtgcagtggtgcgatctgagctcactgcaacttctgcctcttgggttcaagcgattctcctgcctcagcctcccaagtagctgggactgcatacgtccgccaccatgcccagctaattgttgtatttttagtagagacagggtttcaccgtgttggccaggctggtcttgaactccttacctaaggtgatccacctgccccagcttcccaaagtgctgggattacaggagtgagccatggcacctggcctagggttgttatatgtttgacatccgtcccatttgggaggccttctcatcagtcattttatgcctttaatgccattctaggtaggcaggaaaggggtcagggccagtgggcccatgtagcagatagggaaactgaggcccagagaggacaagccacttcttcaagaggacccaaactggatgccaggcaggccctctgtctctgggattttgcccatatggctcaactggcctaagtctgctggcccaaggaaaaatttcaacccaaccctgccctttcccccattcctctcgtgcaggggagttggcgggcctgcggcagcaaataatagctacgcaggagaaagccagtctagacaaggagctgatggcccagaagctggtgcaggctgagcgggaggcccaggcctctctgcgggagcagtgggcagcccacgaggaggacttacagtgactccagcgtgaaaaggttcaggcagctggggaggggtgggcagaagtctgagccagtgtttcatcatcgttcttgctctgcctcggtctgtacacctgtgaaatgggactccctctctgttgtggaggccctggggacagctgggaggactggaggggtggtggggaggttgtggtccttattagacattcagatacccaggtcccaaatctggtccagccctggtaatcctgatgcagagggtccacaaccacatttgggaaatgttgacctaatgtacagcaggaaagcactttcatttgctaagaagtttccatatgaagggccacgcagacctgagcatgtagaaaggcaaggggccagggaagttactagaacactgactctggggttatattgcctgggtttgaatctaatcttggtcgcttactggtgatgctacccaaggtgtctgtgccttcatttccccacctgtagaaatagggataggatagtggaaggtattgaggatgagctgagaccatctgcatagagggcttaacatagtgactggtacttagcaaatgctccatgagttatgattgctggcactggcatgctctccagagtggccctcaggacaggggccctcagccaccaaatcctagacagggcttcctctgacagaggtgcaggctatgactacatggctccagggcatgccactcaccctgcagtccccatggccttgggtggtggttatcacgcttctccatcagggggcggtaaagctctttccgaaagtgctgggattccaggcatgagctatggtgaagctcttaaagaaggggtggcttggccgggcgtgctgactcatgcctgtaatcccagcactttgggaggctgaggtgggcggatcacgaggtcaggagatcgagaccatcctggctaacacggtgaaaccctatctctcctaaaatcacaaaaaattagctgggcatggtggcacgcgcctgtagtcccagatacttgggagggtaaggcagaagaatcgcttcaacctgggaggcagaggttgcagtgagccaaaatcacgccactgcactccagcctgggtgacagagcgagactctgtct

SEQ ID NO: 84 - DNA, 2203 bp, Homo sapiens
ataattcagtaaggtttataattcactcgagatccttatattagcttctcttatttttttgcagttaaaaaaattaaaatctcagtgtcttacagtgaaatttacttctcactcgtgtacatgttgtgtgtgggtttgctttggctgaaggagttgtctttatccaggacatgctccccttgtagtagaaggaaaggagtgccagtggcccaattatgtgttggttcaacgcttttgcccagaaattatatatgtcacttccactcacgttttgtcagaaaaaataagacaaaaatggccaagcctgatggtagtgggatggggaagtataattatgcgtaggaagtgattgagaaccataatacaatctaccacaattctccaactagtaggtagtttgacttatatgaatagatagtggcttttatttgctctctatatgtagagaaataagtaaaacgtttttggtgtcaagttgaatggtggcatgtctattattacagtagtcttctctgtagttggtgataagggaaagggagtaatgccaattgaaaaacatgtagatatgtctgttggattttgattatttttgctagtggagaatagtatcacaaatattttgaaggtgctaatgaccaaaacataattttcattgaacttgggacatattatttttcctttcctttcttggctttgtttctgaatttatctatctctttttagcctgctagacttcagataatagtaatttgctaacacttgagtgcttatgcttggtgtgccaaacattgttctaagcacttaatatgtgttaatacatttacttctcacaactcattgaagtaggtgggatgtaatattaatccattttacagatgaaattaagatagcatttaaataacttgtccaaaggcacacagttaataactggcatggaaacagatataaaagccagtgaattattcattttctgtagttgaatgaagaaattttgttgtattgaataatgtttgagacagaagagaccattggctagtatttagcaattatcatagttatttgatttatattaaaaagcatttgtctttccactaaaacataaagggaataagggcctagagttatatgagttaatagtaattatagtcaagctggggttaaaaatttgttgtagatgatgcatacttggggataattaagagtaccatctaattttctgtcactttagaaaggaacaagtggcaactttgttgactatgtggagaaagccagatgttctttactcagtaatacctgttacttctctttttttccttttagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagatt

SEQ ID NO: 85 - DNA, 1989 bp, Homo sapiens
ttctgcctgggcctgcagactctgctttctctcaagtgctgcatcgacctggagcacggagtgctgcggctgaaagccccgttctcagagctacccttcctgcctttgtaccaagagcctggccagtgactgctgtctcagtcagtccccagagggaaagaccttgccttagaagaagaggcgtgtggggaacgggggctcttgaagccaggtagctggggactatggtgtctgcccttccaatcacctccctgacccctgctgtcccattttccccagctggccgcattcctctctgcttctcagcagctgtcctactccccaggacgagttttcactagagggcccacgatgccaggattctgattcatcttcctcccaagaaaagcaaagccaaatcaagaccacagataggaacctaagcacaatggggtgcctgcttgggctgggtcgaaggctctgctgactgctgtccttgtccatcacccaataccaccccaaacacaactcaacttcccacaccaccatgtctctcaccacaccttctgggcctcattatctcccacaactagaccgccatgcctcaccaacctatgtccctggacctcctggtgtctgcctctcggagtctgtgcacatctgctcacagttgagtgggggaagaaacagccagaattcaatacaacaaagagcgggagttagtataggaatgtccatctcataaggctgagagctattttttcctgtggctgcaaatgtctgaagccagttagtttgattaccctgtgcaaaaccttggacatacttctgctattaacgctataggtatttatccgtttccactggctttttgtacccaccgagcccctgagccttgcgtgtgtgtgtgtggaagagccttgtagagaactgctcctgtgaggcagacaggacagtgaggttgtcaccactcagacttcacctattcagcattctttctgatttctagaactatccacctcattaggccttcttcctatccccatctctggcctcttgagcttaagcttgtattgtcctggaatcagtggctttctaaccccctgccaggctttgccaaagcaaaaagacagaggctttttttttttttttttaaagtttggggtctgtcaggagacagaggcttttttgaattcactgtgaagagaagaacccgaaccttaagacgccagatccctgagagtctttctggctggtttgagtctctcaaatcatggattaggagtaaagaaagaggccaggcgcaatggctcatgcctgtaatcccagcactttgggaggctgaggtgggtggatcacttgaggtcaggagtttgagaccagcctgggtaatatggcaaaaccccatctctactaaaaaatacaaaaattagccaggtatggtggtgaacacctgtaatcccagctacttggaaggctgaggcataggagttgcttgaacctgggagatgggggttgtagtgagccaagttcgtgccatcggactccagcctgggtgaaggagtgagaccctgtctccaaaaacaaacaaaaaaggagcagagaaagacagtggtacagctaacctgaacaagggaactgggaccgttgggctgaaacagtcttgagcctggggttgactgggttagagaagaaccgggatgcaaggagctgcctgtgacacctggcctgccctttctcagctgcctcccctgccctttctcagctgcctcccctgccctcagaaggaaaggagagggctcacttatcacttgtgccatagcacctggtctcaaaatcctaaaagctttcctcgccctcactgccttgctccacaaggtccactttcctgggtcttgtgctgtgcctttccttgtctgcctcctgctgcttctgtaactgcagaccccaggcccaatggcaagccctcggctcagctgcttctccattggaataaactcttgtttctct

SEQ ID NO: 86 - DNA, 1669 bp, Homo sapiens
tccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgttttttttttttctgtctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctttcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatg

SEQ ID NO: 87 - DNA, 2452 bp, Homo sapiens
gttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcaggtgagtggccatcagtcgtggccatcgtggtctcatcatcccagctgtggcccccggtgggctcggcagcagcttctccttggggagggtcctgatgcgggctactgcatccgcagtgtgcagtgagatcgaccagtggccggcgcctgcacctgggcagaccctgaacctacctgtcatgggcgttgttgtccaggtgagagccagctggctggggagtaggctctgcaggtgtgtggggatgctctactccctctggcagctgctccctccttctcccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggagacctgcctaagcaagtcaagctgaaaaagccttcaaggttgaagaccctggacaccaagccaggtctgtgctcccctcgacctggagcccctccaccgtggagaggcctgtcttgtacctggcgggtctctcgggtggggcagccaggcccccagacccctgatcctcttccaggactcagcagcagagctcagaacccttggggaggggtcgctctcttctcttcagtgggtctcggtgtctggggggtgggtgggtgagattttcaggtgcagccaagggcatggggctgcaggcagatgagacccccaccctggctcctctgtggggctgcaggagtgtgggagggaggcccttgaagggtggggcgccagctgtgccctcccgccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggcccctgctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaccccc

SEQ ID NO: 88 - DNA, 1926 bp, Homo sapiens
atgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggagcagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagtttgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaatttggcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagaggccacccacatgccttctcatgttgcccctccatcttcaagccagcagtgatgcgctgagttcttctcatgctttgaatatctgacttcttctgcagccagctggaagaatatatacttttaaagggctcacttgattaggtcaggcccacccaggataacctttgttttgccatataatgtaacattcataggagtgatggcccatcacattcagttttcactcccactcaaggaaaggagattatacaaaggcatccatcatgtggggacaattagcttagaattctttataatgtagctctcacatgacaggttttctacttagtaccttttatggcatcaatgtaaatttaagctgtaaataaaaaacaaatatgtgaagc

SEQ ID NO: 89 - DNA, 2042 bp, Homo sapiens
tttcaaaggctcagagagacctggtgttgactctggaagccttctgccatgttcctccacagccctgtcaccacgccaccatgcagtgcagactacccattgaattattattcaagggaaatcgattcccgtaaacaaaacaaccatcatgtcttcctttgtgctaaacccactgctccaggcttgaaaggcagcaaaaacaagtaaatgactcagtgcttagccaagcacaaagaaaggtggctcaaggtcagaggcagcgtctgagaccatttcagcaatgctgctgcggcagctctgcccactaatcacctggtgcccagagacagcatgtgctcatcgcccttgactttgctgagagcagggagggagcagagcagtgcttagaaacaactgaggcagagtagagtgctggccaatttagtgagtgaattggtgaataaattatatttattgagtgctcatgttgtgccaggcatggtgccaggtgccggggagctagtgatgaacaaaacgtcgtccctgccctccgggagtttgtggtctggtgtgtgtgtatacagacgttaaatgacgaatcccacaaacgtacgtgggagctggttgtgctgaacactatcaaatccagtctcagggacagttatctgggagaggtggaggaggggatgaccaaagtcaattccgaatcctgaaggttggcagcataaaaagtgtaatgagcaaagcagcagatacttctcagatatcatccttgacatccgtgtaacatttgacaaggttggcctctctggtcttttttgtttgtttgtttgagacagagtctccctctgtcacccaggctagagggtggtgatataaatatggctcactgcagcctcgacacctgggttcaagtgatcctcccacctcagcttcccaagtagctaggaccacaggcacgtgccattgctcccaagtggcagctcctgccagactaccccggactcccgagcccatcgtcctgtactcttctccagtgggacgtctggccctcactgtggctagcttctgggcaagtccctctgctcaagatcactttatggggcagctggtgccccctggggctcccacactctgcacatacaatttagggacctggcagggtcttggtggcctgcagcttccctttctggaaccgactcgcctcccatcagagagccataactcttcttcaatacagtattgtttgaactttgaaatatatgcatttgtctatgtattttcttaaaaattaacactgtatctcaataagcatacaatggattgttcaatggtacagtttggaaccaatcccccgccacttccctccccaagtaaagccaggacagatgctggagtcagcatgggagctgtggaaaccttttgccctggagccaggtgcctgtggctgtgcctgggagtggcttcagcccaggcgtggtgtcagtttcctggcacccctgcccaggagcctgcatgaaggcagccgggtctctctctgagtggctggtgcaccggctcatttctgagtggcctcctgcgtatgaagaaaaagcggccacgtggcatgcctcccttccctcccttgctttcctctcaaagagccaagtcacgctgcactgcgctccgtggagcctttcccgatggagaagagaagggaggcctgagatgtcctttgctgggatgtggagaaacaccatctatatgaaaagccccttgcttgctctgctgattttctccctcccctggccctggagagaaaggctgtgccattcaaagacagtttggggacatgggggctgcaggcctgatcttatttttatgcaaattttgttctgggagcagtggtttatacaaactcctgtagcataattccagcttgtgtgtggctgtccttgagtagtgattctgaagtgatgactgtgatgctatgcctaaaaacatcatcagggtactttgtatctgtcactgtgtttgaacggccctcaatttctatctaataaaaccagtcaaatggttcacct

SEQ ID NO: 90 - DNA, 2044 bp, Homo sapiens
tttaagcatgcaccacaatctcctgcaagccttgttaaaacagagatttctagaccccacccctagatatgcctattttgtgagcctggaggtagggagagcattgagaatttatgtttataccaatccctagaagatgctgatgctgctgatccaagagccatattttgagaccccctctacctaaagcattaatgccccatcctggctgctgatccaaactaactgctgatgcagagctgaagtgaaaagtacttctctaatgattttaggttttcaaagaggacttttttttttttgttaaattatcaacagctggcccttgaattgggcgtttggccaagaattctcttgtaactaactgcttctccctgtggctttttagtgagtcaccacaagctctttggggttgtaattacccttaatcctccttcttgtctgtgactgtgtgcctctctttattttttcatatgcttcttcatctctcctgccagctccctagctggaactcagaaggttatttggttaaagcatagagaagtgcagaggaagcaatgtctagtgcatttgcctttcctttctgcacttggctgcactgtacacaacctgtacaactaaaccacattatctatttttcctgaagttcaattttctcatctgtagaacagatagtagcatgttacaagattattgtgaacaagttaaagtacttagttcaaagaagaggctcaatgaatattctatattacattttcttccctgcctcttgcttctctctttcctttcttccctttctcctttcctcttttcttcttttgctctctgccttgtccctaacataaagaacagaaaggagctaatctccctcccttctccactccagactagtcattatacagcctgctttttgctaatctcttgcctcctttctctgaaccggcagtaccaaccttcacgttctaataatctgtcccgatgtcaaggccctggctctgtcattaaagtgggtgagttcaggaagcaacatacatcactttctgagtcatagctttatgtattatttcttagcagacagtcccaatattatgcctactgtcctcatttttattatatttcggccacaattgtggcgtagttaacagaaaagcgcaaaacacaaattatgaacatcccaaaaattatggattattttccaaacataaaattctggctatttacatgattatgttgtgtagtaacacatgaatcatagggacacatttagtagcaatggcattaaaaataccatcaacacctgccctttaagcttttttttaatttcggtattatcacatgtacactttgagcagacgtgcctggccacactgtattgagagcagagactaatgagtccaattatctttgaagtttagagaatcctggtatttcagtggaaaaaaaatgctgtctgcaaagtagagctgttatgtttttcttgaactttagagggcagcagaggagctgtctgaaaaaaatccctacttgaccaggaaaagcatttttgtttcccaagttatttgtacaaaacgttttcattgaaaggaaaggataatattttaaaagatgcttgtaatcatgtttttaagatgaagatattatttcatagtatatttgaaatagaaggacttttttccccttgaaaaaatttactctgtagtaattgatgattaacttgggaagaagtctcagaggaaattttaaaaagggaggattggttatgataaaaataatgtatattggccaggtgcggtggctcatacctataatcctaacatgttgggaggccaaggctggcagatcactggagcccaggagtttgagacaaacctgggtaatatggtgggggaagaaaatagccaggcatggtggcacgtgcttgtagtcccagctacttgggaggctgagatgggaggagcacttgagcctaggaggttaaggctatagtgagacacgattgcaccacttcatcccagcctgggagacagagtgagaccctgtctcaaag

SEQ ID NO: 91 - DNA, 2446 bp, Homo sapiens
agtgctggcgagaggcagagaagctggatcctcatgcatcactgagggtgagagacggcgcaaccactctggagactgtttggaagttcctgtaaaaactaaacatgtaactgttctgtgacccggcagttgctctcctgggcatttatcccagtggattgaagacgctgttcacagacaaacctgaacttgaatgttcgggatcgccagcacaggacctgactactgttacatgcagtgactggaagcctgtcctgggagccgaggagcagtgcgaaagccgggcacagaaggccgcctcctgcacgttcccggatcatgctctggagagcacagccacggcgtcgggatagcacagccacggcgtcgggatagcacagcggctgccgttgaggggctgccagtggctgtaaggggcgcctcgggtgctcgtgccctgggacatctggatctggactccatcatgtccctctcctggtgcggcgttgaccttgggtcctcgtgatgttaccaccagaggaagtggtgaagggcacagagggtctctctacagttgtttcttacagctgcaatgtgaattcacaattttctcaaagtaagtttaattaaaaaacaacaacaacaacaaatgcaaacagaagcctcccccaagcacgtcattaactgcattggtagaaaagaatcactcactacgcgtaaacgctacacaagttggagacagatccaggggcctcagatgcctcggtgtgacttcatcgcttccgagttaggagactggctcactgataccactctttggaccacagttacattttcactattgtttccttgttggtcttgggtgagacggaatcagctgcgtccgctgggacttgtgacctggggcctgtgctgtgagaacgtctactcgggaggctctgctggccctgggccctcacttggggtgggtgctgtttcctacggacgcgcccaggtgccctctctccagccagctcctcccactgcaagatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacagtgaaggcagaggcgtccaccccaagtcaccagagcgcaggtgcagagaggaaaagctgtcagctagtgccagcctccaagggccagcgctacccttcaacagctggaggcaccactgtgcgaggctttccacaccggcctccctcaggaacaagacatcctcaccaggcaggggtgaggtatgggctccaggactggcttcagcaggcaccaggctgaagaagagacaagacaagctcaggctggtcagctccaacacacaccattcccagccaggggaccctcacccctctgggccctgtgtggggactgacacggttcctgcaggaaaccatttgtgccgtttcccacacacccggcagcctgagctatgtggctgacaggtgctcatgactaacgtgtcctcggaagggcaccccatctggggagcgggaagggaggttcactgcactgctcttaacctgcattcacacgtttgaaatttttcctaataaaaatgtaaaaagcac

SEQ ID NO: 92 - DNA, 1737 bp, Homo sapiens
ttcaagagattctcttgccttagcctcctgagtagctgggactacaggcgcccgccaccacgcccggctaatttttgtatttttagtagagatggcgtttcaccatgttggccgggctgattttgaactcctgacctcaggtgatccacctgcctcagccccccaaagtgctgggattacaggcatgagccaccgtgcccggctgtattatctgttaaaggacatttgggttgttttcacctttcggttactaagctctgccttcttgactgtggaggcgcccagcacttgtgtttaatgacacattgttctgccttccttctgtatatgcttgttctgtggacagagtgacctggccctggccagtcaccctctatcacccattgaatggccaccagcaggcccttggatggagcaagcgctgatggccttctctcccctcagaactaccggatttgtttctctttttcgtatcagaataaacaccctgagtttccttggtgtctctccgagaataagatggggaggaaagctacccttgcacagcgcctgtcccagggcacttcctccaggtggtgatccacatccctgggagccccacctctttgtcccagacttccccttgggatcagggctgtcatttgtagacagccccactgggaccctggccgcttcccaccatcttctgcagttgcctctttgttgggcaaagactctgaggttttgcagcacttgctgtgcccgtgcagctggcaccaacagaacgttctgagtctgaccaacttcctccctgtcctccgtgcctcctgcctctatcttcatgcttgtgtgggacgaaggactcccagctccaagtgccagaaaaccagcacagctagcaaagaggggacctgtgtcttgtcccgtgtggctgggacacgccacgtgtatgtccctggcttcaacagggatcagggctcagggagacccctcagcctccctggctgcgccgggcacattcttgtccactctgcaggaccccacacctctgcctgtgaggctggggaaggtggttttccatagcggcagattagtgatatcccagccatgtgacagaggtatgcttcctgagtctgacgtcattccagggaaggattctgattggtgctgttcaggacacaggtgcattgctacaccacaaaagcgagggtgagtcaggtgctcccttctgtggcctgggttgagaaatgggtggtccatcagtgggttttccagacccttccatgtgccgggtgttggcccttgtatgcacatgtgtgagcgtgtgcgtttactcacccttcaaaacctggctataaaaagacattcggtgcagattcatttgaccggaagccttttccttctctctgatttatcctccacatctagcctgtgcccagcacacacagtgggtacttaaatataggtcaaatgacagactgagaacccactgtgatttgtctgtttttgcaaaaggtaggactgcccccttccacgaagaccaatctctttctatgagaccatcaggtgccactcatgtggaattcattctgaagtgaaccctttaaaagaagcaccagtggctttttcttttttagtcaattttccgggaaagtgctgaaatctgcagtgagtgaaagagcagattttgatttccctttaaaaaaattatcataaaagagaaactcagcgtctttgaaattgaagcttcccagaaac

SEQ ID NO: 93 - DNA, 2025 bp, Homo sapiens
gtgagttgttgcttatgcatttagtgcatctgtgtgatttttctgggagacattggaaggatctcattgtagctgccatcatcccagagccccccagcaagattttaagctgatgggagacagggccccttgccgaacgtctgacggcacttcacatattgttctgtgtgcaacatggattcgataaatgtttgtagcatacacgaaactgtctaactctgggtttgaactccagccccaaagcaggcacaattctgggcttttggtattacatcctttttgcagtttatttggaagatattcatttgggcgacagggatgtactgtctgggtcagatctgggaagagtccaccctctagtgggggagagtggctctctgctgcctgtgtatggagataatgagtttcaaatgtggaactggctttggagttcatgcctgccactccaaaaaggcaagaccagagtggaacatacttgggcaagcctgtgactcccagtacctttatctcttaaagggatttatacagcagtcacttgtctgcttctttgcctaggtccctaattaaagcagttttcaacccgataaacagcctcaccttggctgatagagttggacaactccttggtggcccgtttccatgccctctcaggctctgtagctccagggttaagttcctgccttcagcagggccacccactgaaacatttaatgaggagaggagtattgtttcttggagacataattaccagagacacttaatgccacctttcccaagataacaggccttttgaaatgcagtgtgttggggaagatttagccaagctcagtgactgccttagcagttatgagtcatattaataatgcctacatctgcctccaccaaaaggctctagggtctgtctccgaagtttattaaactcttccttgggagacttgtgcttgggacttagggttctaagtcttttctttcattatttttggctgtaactcacttttacgtggttgtggcgctgggcaaaattttgaaataggtaacttccctttgcattctcccagtactataagactcatacgtcctgggttttaggggtgcaagccagtccttgcattttaccaggattcttgaaggctgcaaactcgggatgtaaacacaagccattactgggagagcatacttgagacattggaggcctcttaagatgcttgccttctcaggagctcctgtctcccaaaaacacaacacaacaaagcaaaacacagaaagcacttctaatgaaagacttttatttaaatgtaaggaggcacctacttaaagtaactcttaagaaaatcacttaataaatatatatgacttttgtaatgtaaaaaatgtcttcctaacttatttgttttaaaatttcaactttttgacatcgtactgtcatcctttaaagttttgtgggttttcttagttttgaactttttcttccttaccgttgtcttccccctcatttcctggaaagggaaatcgtttccttctcatgatctgcgaggcttccttccctcctctctcttgtcgttgtttcattttgttttcgtcttttggccccaaggaagcagacgaagaatcctggagtgagagagacccgggttcccattccaactttcccctcacttgctgtgagactttggcaagttcgttggcttgtctgagcctcagttttcctccttgtaaaatggatataaaaatctctgcaccactgagttgcagcagtattaatgtcatactttatacagcatgcctagtgcctgccccagtgcagatgctcaggaaatatcgtccttacttaggagcactcctgtcaatgaaaacaggacctcttgccaaagagaaatattttgtgattagtgcttgctcctgtccctgcccccatgagcaagtgtcctccctttctcctcctgcattgttgaggacacgtttcttgatacaaatttaactacagccactaaatcagaaattcccacccaaagtcataccataagc

SEQ ID NO: 94 - DNA, 3703 bp, Homo sapiens
tatccatagtttctttaaaatagtaatattttaagccactcaaaataagaaaaagtcaaagttcacaataaaaagatcctgatatacctgaataagatttgaaaagtgaagaacaattccttccacctgaaaagggtgttgacccagaatccacctctgacgaccctctagagctggcaagtcagcatcattcccagtgcacctgtgactgatgacacatctcacccagctgccatagggatgtcaaagacacgggatacagtgctggaaagggaaaaagcatcagtgcaaaagtagatttcaggatttggagcacggaggcaagtgccctctcctggcatccccgcatggggccatggtgaggaggctctgcagtcttccaggacgactggaccatggataggaaatacccaagacatggattctctggggacatgggcgattccaaaagcaccgaggagtgtgcccctagagaagcagtccattgggtccatagtaaaatctcatagcataaccaacagtggagaccagagactaaaaatctgtaacatccttggagtccatggacctcgaagccaaacacaacagccccacgagcatctgccatccaggcatggagagctaggggtgagcttcttagagtaaaggaggcttcttccctgttcagatgtgtgaacggttgggtttacagataatggaggtgtctgtgtatgttgtcatgaaaatataaggcaagtggcaccaaatgtgatttagcggtcccagaaattcagtgctgcgtgctttctacatgacattaattttaattatatgtacacaggagaaaatttaaaattgaaatgtcttatcattgctagaaaaacagaagttttttccctacgagttagaaatcttgatctctgcgtttttctatggatcgattctcaaagtttgtgcaaatacagtcggtgtttctctctaagtgtctttggttatgaactaaggatgtaaccaactcctgcttattaggtaaagggatgaggcaagagagatccagcaacagggtatggttatttttcagtctttggcaacatttttcttcgtgatgtcaaaagtagtgaactccctgactagggtttcagacatgggctgttctaatccaccaaacaccaaacggctggggaagaagagatttggacatggataaccagtgtcacctacaacatggaatggagggtcgtcaaaatggtctgagtcactttaatatgtggctggagagatgcgagaacaacagaaagagccctcaggaggcatccccacccaaggtcagtgaagctcagtgcagctgcagggtgtggggtcatagggtgaccaggtgaccgggctgatggggaggaaaaatgctctgttaagggtgttgtctctgtcacctcttcaagaagcagcacagtctcaggcacatgttccctcctgctccccgccacacacacacacagacccactgcagctcttccaagattcttccctccattctgggacctccccttcctcctgagcccctgtggcctctatcttactccctttccccagttctttgtacctccctcctctccctcactcatgtcccctcccatgcaaagcccctactggttcccccttccccacttcacctccactcacactccatcttcaccctccattccagtccttcccttcctctcctcactctgactcccctgataaactcacttcccatcccctctgtccatgtccctgcctcagtttacctcccttcccctctcctcacctcccttggatgcacctgacctctcccgcctccctccccttcattcatgcccttcccttcttcgctctccagttccatctcctccaacatgctcccctccccctttccttcagcctctgttgacctctccaccctcccgcagtcccctgccctctcctgctaaggccatccctcccagccatccccgccctccctacgtcacctcagttggctccatgtccctcagctcccatcccctccttcttccctgccctgagagccatccgggtttcctttccagtctccctctgctcctgtgctttcttccccttccctcacttcccctgctctgtcttctcctcagttccccgccctccctctctgcacctgcccagtttcccccatctcccctccatgctcccttcctccccagctcctgagttggaccacctcagctcagcgccctacttcctgtgcctgcccctgcctgctgcccaccatccctgcacacagctcactcctccctctggccctcctgctgagcaggcggctcccccactgccctgggcctgcccaccttccccagcccccgcagtcaaggctctccaactccacaccaccggggtgagggcagagaggcaccctctccagggctgcgcttcctccagcaggtaccagctcctccccctcaactaagctccatggcccatccctgccctgggggcgacaccacagggaccttccgctcaccttgccaggcttttcagaggcctcggagctgtggtcaggcaggcgaatggggagcaagccaggggttacagatccagagcctagggcagtccaggcagggggggctgtggtcccctgtgaccacttctgtgaccttgccacttgaatcctccagggcctgtgtcctcacctccaacgtgaagatcaggctgggccattattgcagagctgtgctgagtgttgaagaaggtgcgtgtcacgcgttattataggtagctggtgtttcctgagcgtttggaaacgacgctttgtataatactgtgaactaaccgcagagctgggcacagcatgcttcatgatctcattttatactgacgtgtttagtcatcgtgctgtcaagtattctccagccacatcatttgttagtagtttgacctgcataggagggcactgtcaccctccctcctgctgtgctgatttcagctggagccgccaggccaggccgcctcacgcgccccctgctgactaacccgggaactgcccgcagcctgctctgagctttctgatgtgggcgggaccgggccgggcagggccaggcgcctgcggggaggggcggggcccggcgactgaggggaggggcggggccaggcgcctgcgggaggagacctggtccaggatcaaggagtcgctcagtgcaggaccggcccagagttcacatccctggcttgatctacaggtaaattttttttgtatactttaagttctagggtacaggtgcacaacgtgcaggtttgttacataggtatacatgtgccatgttggcttgctgcacccataaactcgtcatttacattaggtatttctcctaatgctttccctcccccactcccccacctcccctactggccctggtgtgtgatgttccccgccctgtgtccaagtgttctcattgttcagttcccacttatgagtgagaacatgcggtgtttggttttctgtccttgtgatagtttgctgagaaagatggtttccagtttaatccatgtccctgcaatggacatgaattcatcttttttatggctgcatagtattccgtggtgtatatatgccacattttcttaatctactctgttattgatggacatttgggttggttccaagtctttgctattgtgaatagtgccgcaataaacatatggacctacacgt

SEQ ID NO: 95 - DNA, 2336 bp, Homo sapiens
tgaggcaagcccacctcggaaggccagctcaggtctcacgtccactttggggctccaggcatgcgggaaccccaatgccagtacggcttcctcggctccgtgcagcaggcgctcttgacccccacgtcatggaggaggccttggcctcagactctcctgcatggggtctagcaggagccaccggctttgtgattcctggagtccggccacgtggacctggcctaccaagaagactcacaggcttgacagggcccagcctcccagagcagcaggagcgcggtcatggccctgctcacctggctggggacagctcttccccacccctgagccacctccaggcctggcgagggccctgagcacctacaggacatgggacagccagtgtcgcagcctgaagaaccgtcctcccttaacctggctgctcaggccttggaagggcggcccaagggtctgctcctggcctgtgtccaaggcagccctccaggtgtttgccaggatggatgccaggatccgggtgcacctggctcgcatggatccatccccaacaccctacgtgacaccaggtgtccccggcagggaggggcagtgggaccagcaagccctggccctggcccccagtccctccacacacaagttctcatcctggggtgggccaggccagacatggtcacacttacccctgctcctgcatgggggacagggagggtctgtggggctccctcagccctggggctcatgggattgggccccactgacccagcctggtctgttgcagtgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtgtgcgtaggcgggcggggggtgagggggaacgagaccagcgggagtgctcacaataccgtctccaccccacagatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctct

SEQ ID NO: 96 - DNA, 1438 bp, Homo sapiens
gtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatatcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcataaacttaaagaagtaggtttattcattcattcaacagatatttgttaagcactcacatagtatcttgcaccatgctaagtgctagatacaataaacaaaataaacattgtccctgcccttttaaaatgccctaatctgattgctgttttaatcatctttatgtcatataagatatcatgaataaatactttcaagtcact

SEQ ID NO: 97 - DNA, 2241 bp, Homo sapiens
cacaacctagatccctcacatgtgcaggtcacgatagggttcgcacttctgtgagaatctattgcaatggctgatctaacaggaggcggagctcaggtggtaatgttcgcttgcctcctgctatgcggctcggttcccaacaggccatagactgacactggtccatggcccggggattggggacccctgctttagagggctgttgcaagatttgataaagtatgtaaaatctagtgtaagtgcctgatacatagcaagggctccgttaattctagatgctgcctattatcattattaaatgagcaaaaacaactgttgtgattactcttctaccctagccctctgacgtaacagccaatgagctagaaaaccatgtggactcctatgaagccattctaagtcacctggtcctatagctgaaggactgtgaagttccaaacttcaatctgacaacccctaagaaggtcttccctggttctggcttgcagggatatcaggagtatgcaggtgactcccaaagcagaaaggtcataaaggacaagggcaggttagatgggtccattgagagacggagaagccccctgctcctcactgagttgtggtcaggggcagtggagaaaggtctgaggtccaaggggaccccaagtctgaatataacgcagccacagaatgcctgtgctgaagtgagactgctccagggagacaagcagtagcacaatgtcccgagttgaggggttggggttgtcctcccctggcccagggaacactatgcccagggcagcctgatgtcacaactggtaaggaccactggagcctgagtcgggaggaaaacagcctgggtggtcataaagaatggcagagggccagagcagggatgtggcaagactgacacccttgaagtcaccagaaagctatccccttggacttgggcagaagtgtctcttaatatgatgatgtattatcattaatagttgccacctgctaccatgtattgagcacctattgtgtgccagacctagcacttagctctttacatgggttatctcatgtgatcattgtaagaaccctaaggaggtttttcttactatcctccattttacaggtaagaaaactgaggctcaaagaggttaaatcagttgttccaggtgcatagcttgggcacctagcttgcaagtgacaaggcgagcccaatgccacccacaccagctctggttctttgcctccagccctggctcctttctccaaccatcttccctctctgccccgggcaggtggggagaaaaggaagaaagagaggcccacgtcatgtgtttcagcttccctttccctctctgctggtgcccactggccctcacacccatttcttgttgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctccggggtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgc

SEQ ID NO: 98 - DNA, 2159 bp, Homo sapiens
aggacacagtgagcgcttcaacgcgctgaactaaacgaatgaaggggaacaccaactcagctgtcacccccgcccccaagtgtcactggctagaagatcttcccccggttcgccggcagcaccggtgggtcttgtcacctctgcgccccgcagccctccggaggctgcagttgctgtctgctgacaggcgtcccctcaggagaacgggagctcctccagcgcagggccctgctcagcacccctggtcccgggggcccccacggaggccgccgcgctcagtgaaactttgccgcgcgcagcagtggccggagacccgcgcggaccctctccccgcggggacccgccagggcgagtcgcccctcccccgcggcagacgacccgacctgggccaaggtcggccaagtcctcgccgcctgcccagaggcccttggacccacaggacccggacccgagtgcgcggaagcctccgagccgcggccaggtctcagaatgcgcggcggggcagcccggcccgtcaagcagcgaagccgaaactagaagcctgaggtctggcttggtcactgtttgctggggaactccgacgagcaactacccttcggggactcagtttcccccgggccaagtgagacggacagctgcggctcccgcgagaactcgcgcgggaacaggagctgcgggctccgcacagcgcccggcacgtagacccagtctactaacgggctggaaggtcgcgctcccgcctccgcgccgccctagaacctttctcacctcaaggtcgggctcccggactctctcacctcacggcccctccttccaccttgggccgcccagcctcaaccgccctcacttccgctgacccgccccccggaagcgatcctccgcagctgcgcaccgagccgcacctccgcgcaccctcaggaggcgggtccagctcggtggcgaggggagcgcggcccccgagtgggcgaggcgctggcggctgtaggctccgataccgcggagcacactcccctccatcgagaccgtgcccccgcggggtctgtgtccccgggaggagttggctgcgtttggagatccctcggcctggtattcgtcgcgtctccctgcttgttgctctccacgtttagccccatccgacttctggaagcccaggggtgtgtcgctcgacccctaaaatatgctcctacccctagggcaaacttcagaatcctcaccctggcccccttcccagttcttggttcccaggcaggtccctttgcaaagcctctctccagcaagaatgcgcagaatgggcctctttctcctcttgactcctgccctccagcactttgcagctttcttctattttagcctctctctctctctctctctctctctcacacacacacacacacacacacacacacacacacacacggtatattcaatgagtttgcttattagatgggtacttgatgtacaagactccagaggctctgtgggaagagccacattccttccaggctcactaacccactccctctttgtgctccagccctcactgtcttggtctgtggcatgcagttcctgggtcacatttccttctctgccttcagcacagcctcgggctgtgcctggctcccaggctggagttccttggttccaaagcctgcagtcccctctgccagagacagagctggtttcatgggtgaacagcccatgcagtcacaacgggccgcatgctcagaatcctgtacttggtttagtactttgctgttgccgtcttgaaatgattttctaataggggttcttgtgttttcattttgcacggggctgtgcaaattatgtgactggtcctggctagagacctcagaggtcgtccaccctgatctccaccatatctcaaacgctgaagattgacttccaggtctggccctcttcccaggatggcacattgtgttttaatcattacctttccctcctgtgcgatggcggatcatgcaagtccacgctggctgtctgtcctgggtgtagatgctgatttggtgtcccactcagatccccttgcaggaagaacggagctccctacctgggaatttccttccttcttttactggtttttctggaagtacactcccccccagccccaccaaacaaacaaaacaaacaaacaaaaaaac

SEQ ID NO: 99 - DNA, 2200 bp, Homo sapiens
tctggcctccctccctgctggcagcagagattggaggtgacatgaccagccctgctggccctcccctcccacattggtgctcattgcctggccatgggcaagggctcctggagctgagtgaacaggcactgggagaacagctgtaggggtgaaggttaagagttttttcagggactcagagcacaggagtcagccctgggaccacctgaggtccaccaagggggaggcatcaggatggagcccttcctgcctgtccagggcatgcgtacgccacgcacagatgttgacagcatggtgctgttgcccagtgcccccctggagggagatggagtccacagtccttccgttcactcagtggccgtcactgaggcccagtcacgggccagccaggctctgggcactcgccctgtcctcagggagtgtccaggctcgtctccttcatgttggagggcggagggctttattccatcatcacaaggccaggaggaaagtgaggctcaccaaagggaggtgacttgcctgggccctcacagctggcagggagcagagccaccaggagcccagggctgcctgctctgacttccgggctctccagcaccacgtgccctacagctgagagagccatcctggctgagtgtggagggcaacgtcccacccagcgcccctcaaggccacgagagtggacgtcgtgcctgaggcccggcagaagctgctctctcctgggcctcaggtgaaggaggtgccagcggcttctgcctatgccggcagaatactccatggccgactgaggcactgcctggccgggtctctggtctctgccattgtccccctgggtcactcagggcagccattgcaagacaatagcagagccagagtcccggatgccagtggcttctcggtagaaacagggatgacaaggcattgtctaaagggtggaagaacacccacagtgggctgggggtttatgcgtctcctgcactcctccgaggagtcctcctggggctctgggtgcagcacaggctggggcagcaggggatgtgaggcggggtcccggtagacaggccagctgaggcttctggctacagggatggccaaggccccagagggtatgggatgcagaaccacatggtgttgtggggtgcatactaggaagaagtgctctcgacttgtatcagtggagtgtctgcggtgaaggggtagggaggttgctactaaggagactccaggcttagacccgaatgtccatccacctgtcactgtccccaagctgcagtcagtctcctttgggtccgaccctgtcgtctccctggtagcccagcaagcacagtgcgaatcagtttcccctggacgctgatcctggtcgccatatgtggggaggcgacagcctgtacacctccacagacaggactaagtcagggctgtctggtggcaagggacagaaatcccaactccaacaagctttagaaaaaaattgtttaaaatgagttgctcttaggccgggcgcggtggctcacgcctgtaatcccagcacttcgggaggccaaggtgggcagatcacgaggtcaggagattgagaccatcctggctaacacagtgaaaccccgtctctactaaaaatacaaaaaattagccaggcatggtggcgggcgcctgtagtcccagctacttgggaggctgaggcaggagaatggtgtgaactcgagaggcggagcttgcagtgagctgatatcgcgccactgcactccagcctgggcgacagagcaagacttcatctcaaaaaaaaaaaaaaaaaaaattagttgctcttaaaacaaaaagcatgatgggtttgacttcaggcagggccaaatccaggtgttcaaacagtatcatctggtattggtctcaggcctctgatccagattgctttaaaaaaaaaaaaagaaagaggacaggcgcggtggctcagctgtaatcccagcactttgggaggctgaggcgggtagatcacgaggtcaggagttcaagaccagcctggccaaggtggtgaaaccccgtctctactaaaaatacaaaaattagccaggcatggtggcgggtgcctgtaatcccagctactcgggagcctgaggcagagaattgcttgaacccaggaggcagaggttgcagtgagctgagattgcgccactgcactccagctgacagagcgagaatctgtctc

SEQ ID NO: 100 - DNA, 1721 bp, Homo sapiens
agtgttatgatgcagttccacaacacacagccacattcacccacagaccgaggtacagaacgagagacaacctctgcccccccagcagctggccagctttgcagccccagtcttgagcccccaactaccctccccccacccacccccatccccttcccaattgaaggagcggaaagagaagagagaagagtgagcagagagattgagagattgagagagagagagagagatagacggagatctctggagcagacctcaaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccatggccgagcctacctgtttaactccgtggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcactttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttg

SEQ ID NO: 101 - DNA, 1636 bp, Homo sapiens
tttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtaaaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcgtccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattataatacaagtattgaatgaaccattgaaacactagaagtcaggatgtttccgaatgccagggtttcaaaatcaagacaattctatgaagtaaaaagtagattagctattagaacaaagctgaaattagaaccttatatgctttaaataacttttaagaatttgcttgacctgtggcaatccaaaaatacatcagtatttataaattctagacttctgttactacttctggcatatccacacttttttctgtcagtggattacataattggaaatttcagtacatctagactgtctctattttctttttctttttttatttttagtagagacagggtctcactgtgttgcccaggcaggtattgaactcctgggctcaagtgattcacccacctcggcctcccaaagtactaggattatgggtgtgacccactgtgcctggccattttctttactgataaaaataacttgagaaggtcc

SEQ ID NO: 102 - DNA, 2261 bp, Homo sapiens
ctaggtattcctgagttttactctgtgacacatttaagttacttggaaaccatttagttctttcaggacttgtttttaagttttctgagatgggagcagagcagcatttagtctaggactaacagcctactgagaagcactctactctatgctctgtgaattgtgaaactttccactcagggtggtggaaaattaccactcaggaagctagaaactattcctagcttgttccttaacccttttggatgactatttccttagtctcggaatatggaagaatcatgtagccaaggcctaggtatccactaggtaggataggcacagtgcctagggcctacagtactttcaggggctcatgaaaatattttaatttattttatgattggaaaaaaagtcaaagaaaatgttttaatacatgctaagatattcatctttatgacaatataattggaaaacgtggctatgtggaggaagtggtacaggaaggcaaagttgactggggcccacagaaacataatgcaatcttgcatgtgggtgggggagagcatattggctatgagccgggggtgagcatcatctctcaacagatagtaatgaaacggtgtaattgggtgagcttccaaataaagctggtttcttgggaaacaagccaaaagcaaagcttgggctctgggtttgacccctaatggattggcaagagaaaaaggaggaacagggtggccagagagagaaaggccgtcaacgaggcggtgtgggtggagtgcagagcagggcacttaaagtcggcacacccaggacaagttcacttgcatttgtcagcctgagtttccttgtctctacaaaggagttagtgctaactgccttgcaggaaggctgtgagaattcaaggagatacgtgtgaaagttttgcagaaaggacaacattctctgcaagtgtctgttattagagaaacgagaaggatccaagtaatggaaaccaagattacagagaggggcgtattagagtcacagaaggatacaactgggatacatccttggggccacttaatccagcgttcctagaggaagaaatcaaggtgtcaaaggcatcagaagcactgtgaagtgatggagaccatggacagtgatatggtttggctgtgtccccacccaaatctcaccttgtgttgtaataatccccatgtgtcaaggacagcaccaggtggagacgattgaatcatgggggcggtttcccccatgctgttctcatgatagcggtgatagtgagtgagttctagcgagatctgatggttttataggggcttcctccttcgcttggcacccgttatctctcctgctgccctggtgccttccgccatgattgttaagtttcctcaagcctcccctgccatgtggaattgtcagttgaacctctcttctttgcggattgctcagtttggggtatttcttcatagtggggtgagaatggactaatacaaacaggaacttacccaccacccatactgccatgaagagtctggaaaacaatgtttcaaagatttcagccactatgatcctgggagaggtgaagagggccaggatgctgctgagtatcagtccagtatccagcacatggtaataaacatgaatgacaataatgggacttcccatccagttgtgaatgatagcactttgatgttcggagcccaatgtgctgcaggtgataagccctcagaatctgctaactcacaaagtcaattttctcagaacctagttagaatgacacactcatttttttttttttttttttttttttttttgagacagaatttcactctatcacccaggctgcagtacggtggcacaatcttggctcactgcaacctctgccacctatgctcaagcaatcctcccacctcagcctcctgccacctcagcctcccaggtagctgggactacagacacgtaccaccacacctggctaatttttgtatatttttgcagagatggagtttcaccatattgcccaggctggtcttaaactcctgggctcaagtgatcctcctgtctcggcctcccagagtgctggaattacaagcatgagccactgtgcctgaccctcaatctcatttctaatccctaattgggtaaccgtctgatttgatcggacagtttgggctgtgataggatccttgtcctgttatctggactcaggaccatctgcctcctttattccagctcagagggtgaatggagactcagaatttcatccaactgctcag

SEQ ID NO: 103 - DNA, 2160 bp, Homo sapiens
ttacagctggaaacaattgatttgctcttacgtatttgtgtgacttgactcttcaaacacaaaggttaacaggaagatctcgagggccctggctgaacttcaccttttggctttcttggcctgatgctgaactctcgaggttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatatt

SEQ ID NO: 104 - DNA, 2215 bp, Homo sapiens
aaggaaaagggctcctagatggaaacacaggcttgctactgattaacatgcctggccgaggccgtgggccctgcggagggtgtgcagcctgctgaggtcctaaatcacgaggcttccgatcactcctttgtctgggaagccctggatgggttggggcctcccttaggtcgcctcagccagtccactcccctccgtaccccttcctgggggcaagccccaagtctatcagcctccctggcatcaggttggggcccagagacccctggaggcagtcggtgggggtctgtggcagccctactggggcttggagctcctcagttgaggaagctgctgtgtgtgggccccaccaggcctgcagggaccgaagcccaaccccctttcccatgggtgacttgggaccagaaccctgggtacctcctgggggtgaaggactcctgtgtccttagcccagcaccctgtctgccccactcacgcccactctgcctgggccccccagctcctggacacatgctgtccatgcctgccctcctcttttgtgggtgtcactgacccccgcatggaggagcagcagggctggggtcaggctgagctttggggctgccgccaggcgggggaagcttgcatggtcagaggtggggcttgcagcctgtggtcttgctggagggggcatcagccacgctggctgccctgaggactgtgacgtgtgggcagaaggggcctctgcagcccagctgtggcccctgctgggacatcttcccaccatgaagacaggcacccagcgaggcacctgccagacactcagaggcccctggatggaggtgtcctgaaggcagctgacaggggctggggcctcaggaacagggatttgtgcccacttgggggtgtctgggttgccccagggatgggggcaggggaggggagcccaggccagcccagggccccacactcaggggctgagcagtacacaacagccacagtccctggacctggggccaagggttctgaggtgggggcggcgttctgggctctctgggagtgggggcctggcagaggtttcctggcagcaccaggtatccatgaggtacgtggccctggcccctggcatgctgtggggcggaggctgtgcggcctttcgggtccctgtctgagcctgccccctccacagttcttcctgctgctgctgctggtgttcctgctggaggccaccatcgccattctcttcttcgcctacacggacaagattgacaggtatgcccagcaagacctgaagaaaggcttgcacctgtacggcacgcagggcaacgtgggcctcaccaacgcctggagcatcatccagaccgacgtgaggcgtgggcaggtgggcggggtcggcgggtgccccctcccctcctgcctcagcccgacctgagcttgccccccagttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctggctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaaaaaaaaaaaaaaaaaaaaaaaaaaaag

SEQ ID NO: 105 - DNA, 1745 bp, Homo sapiens
attgtatttcgccagcaatgatttatataaagagtactggagttgacaagcagggccatgaatcgtagcacatctgtgatttgcttgcaaagcaccgacaggggcagctttgctcgtattttcttggtcagaggacttgcctctgctgatgggtcccgtcttcctgcattcaccatcaacctttcccttagagcgtggtaggcacttgtgcccgactgcagccccgtcccacccagccgctgagtccttccagcccctgaggctgaagggagcatgggctgggcatgaactgggcatgaactagaacccgggcatgaccacacgcttctagcctcagctctgccctttgctgttgggtttcttgagttgccttattccacttggttattacttcgtttcctcaggtaatcaggactttgtcagcttgtctgtccatgcgaaattgtagcagaactagaacaatagcacactaaaaaaagtgacttaaaagattacaaagaataatttcattttaaagatcaaaaatctgccatttagagaatttaggaattgtaagatgtcatagacctaatttgtggcaaactttagagtaaaatcaggtcttctgctctcagccagcattctttctctcactccattctgcctcttcagaacatctggagggttccagggctttggaacacaatatattatgaacatgtgaacggtaacgtccccatttgtggaagtattttcagtttgttctgggagaagagaaccttaagtatctccttaagcatgttatgctcttctagcaggtcgtaatgttcacataaaaataccaatttagccttcaaagcaggccttaaaagaaggtgttatcattcccttatatagaaaggagcctgagatttaaagcgcttgaggttgacccctggccactaagttactaaatgacagagaaggttctgaagcagaaatcctgcatccaagaccagaaatcctcctactatagaacagctgatctgtgtgttttggcctttccattttatgacacttttgtggcactccatttctaatttatattctaagatgtgtcataaagattcaatgaaaatttggcagagaatattttatattgctcttcttttctaaagataaaaatggtaccatgtcttcctcctgacctgtgtactaaaccggaaagaatggcttgcggatgggcagggagacgttgctgggccgggctgggagtgagaggtcggcggctccctagagcaggggccacatcgggacagccaggactctggtgctgcctgaaaacgttccctgagcacccgcagtccctgtggatgctgctgtcccacagtgctctggtctctctgatggcgttcccgcccaggccctccccacctccctgcatacacacacacacacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatt

SEQ ID NO: 106 - DNA, 2836 bp, Homo sapiens
ttttcatgtgttttgtataattagtcattaaagaaatgtgaatcaaagcctcattgcgataccctacacacccacagtgatggctaaaacttgaaagaactgacggtcccaaatggcgagcacatggagcaatgggaatgcgcatgcgctgctgctgggaatgcagtcgcgacagccagtgtgaagatgggttagaccacccagcagccctcctggggaatttttccagaacaaatgaaaacaaattccacaccaagacttgcactcaaacactcatagcagcttcatttgtttgtctgtttttgagacagagtctcactctgttgcccaggcaggaggagtgcagtggcccgatcttggctcgctgcagcctccgcctcccgggttcgagcggttctcctgcctcagcctcttgagtggctgggattgcaggcgcccgccaccgcacccagctaattttttatttttggtagagggggtttcgccgtgttgaccagtctggtctcgaactcctgacctcaggtggtccgtctgccttggccttccaaagtgttgggattgcaggtgtgagccacctcgcccggtctgcaccttcatttataatcgtcccaaactggaagcagcctaaatgccagtcagcaggtgtgtggatgcgacagtgccagatccgtgtactgagaacactcggcagtgcaaaaggaaggtggcaccagtgcatgacagcacaggccactcagagacagcacgctgagtgagaagccagacacgaggctgcatattgtatagtggcatttatgtgctactctaggaaagaaaagtccagtccatagtgacagatattgagtcggtggctgcctgtggccaactgcaagaggcccatgggagcttgtagggatgctggaaacacaggtctcctgactgcggtggtggagaactggctggatgcatctgtgaaggccctcaactggacacttaaaatgggctcatgcttgtagagtagaaattacagctcagttaatttttcaaaaaagttaattgtaatcttcctggcttctagaattgcagacttttagattaggagtgggtctttgagattgtgttgtcctcacacaacacaatcccagaaaaatagtggcagaaacagaacaccaagccgggttttctcccttgcctctcagtgtccttcttaaaagtcatgctgcaggagatcccgggaaataggcgatgggcatcctcttctccccttctgttctagactcgcctgtgtcccaggggtcttttgctctaaaaggtgtgttatgtcggtcagtcagtgcccacagcacccagggttagcaaggtgatgaatggtagcagtgctaagcatgtggatgagacgttcatcctgagaggcagggctgggctggcccatgcctataaaccaggcctcctgagaatgaaggtgtgtggggtgggctgggagcttgaggagcctgcacctgtagagcagcgaggcccccgagcagccctgctgcacaggccagtcctgtgcttttggtctcatgggtccgtgccctcagctcttgcctggggtggggattgggggacacatgggcagggttcaggccagcaggattccttgctgaggccttctctttgctgtctcctaggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaattaaaaccc

SEQ ID NO: 107 - DNA, 1968 bp, Homo sapiens
ctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactgcaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccttttc

SEQ ID NO: 108 - DNA, 1626 bp, Homo sapiens
gcggcgcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgattggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcggtgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggtgagcaggcctggggccccctgtcagctccccaggcctttggggtatgtcgtcaacccttaaaatgcggagccctggcagggcgtggtggctcacgcctgtaatcccagcactttgggaggccgaggcaggcggatcaactgaggtcaggagttcaagaccagcctggccaacatagtgaaaccctgtctctactaaaaatacaaaaactagccaggtgtgcttgcacgtgcctgtaatcccagctacttgggaggtggaggcaggagaatggcttgaacccgggaggtggaggttgcagtgagccaagatcacgccactgcactctagcctgggcagcagagcaagactccgcctc

SEQ ID NO: 109 - DNA, 2203 bp, Homo sapiens
agtgtagggcacaccctgagggtagcgagagacgtgacaggaccgagcagctgggggctgcagcctgctctgtccccaccgatcccagagagaggctgtgagtctggatctgggcgttcgcaccctgagagagggggtcaaagctcccctgcggccccgaggaagaagagcaaggttgaggacagcctctggtcaccagagtagtttggaggcaggcctgcaggcgcgtccccgctcctcagctccaagctgacgtatctacacctgccggcgggcattaagatggctggttatgccactactcccagccccatgcagacccttcaggaggaagcggtgtgtgccatctgcttggattacttcaaggaccccgtgtccatcagctgtgggcacaacttctgccgagggtgtgtgacccagctgtggagtaaggaggacgaggaggaccagaacgaggaggaagatgaatgggaggaggaggaggacgaggaagcggtgggggccatggatggatgggacggctccattcgagaggtgttgtatcgggggaatgctgacgaagagttgttccaagaccaagatgacgatgaactctggctcggtgacagtggtataactaattgggacaacgtagactatatgtgggacgaggaggaagaagaagaagaggaagatcaggactattacctaggaggcttgagacctgacctgagaattgatgtctaccgagaagaagaaatactggaagcatacgatgaggacgaagatgaagagctgtatcctgacatccacccgcctccttccttgccccttccagggcagttcacctgcccccagtgccgaaagagctttacacgtcgcagctttcgtcccaacttgcagctggccaacatggtccagataattcgccagatgtgccccactccttatcggggaaaccggagtaatgatcagggcatgtgctttaaacaccaggaagccctgaaactcttctgtgaggtggacaaagaggccatctgtgtggtgtgccgagaatccaggagccacaaacagcacagcgtgctgcctttggaggaggtggtgcaggagtaccaggaaataaagttggaaacaactctggtgggaatacttcagatagagcaagaaagcattcacagcaaggcctataatcagtaagatgtgtgaaaagttgggtagccacaggaggtgttcattaaggatatgattccatttatatagctatttctattgcataaccaggacagttttattgttttgaggtcaatgttcttttaaaatttgattttctgtaagaagaggctttttggcccagaaagccttacttattttacatcttccagtttgtccatcccatgagttagagttcgtcttgactctgcaagctagaatcaaagaattatgaaagtaagatcatttagatttgaccaagggcaccattaaatggtgtcaggttttaggaagcagacgggtgtataaaaagaaaatgaacaaagatttcacttattggggatcaggcataactggatgcctggattgtcctgccacccagctgccaccaataaaatcattcatcactctgcaagagggaccagatgcttccatcatcagtactccttgtttttctgttatctcctttgaggtagctaaaaatggcagccaaaaaaaaatgttgaggcttttctcaagtatatactcatgttattttgcagaagatagggtcaacttcttcagttgagttatctgaaagtgttgggcagtgacaccatgccaaacactgttaaattcatgccattaaaaacagtggagtgttctgcaaagcccgattctctgcagctttaagactggacagtattgaaatattcacaggaatcttccaagccgtgaaagcttaatattaaacagcccttttaattgcaaaggagaaaaaaatggagacacttgtgaaaccttgcattctgagtgctgccacaaataaattaaggaattccagaatttcttcatctacttctgcagtcttaactctgaattaatgactgtatatatcaaacttcagatcttaaaaaacatcagctcgcaagaggctgaggcaggagaatgacatgaacctgggaggcggagcttgcagtaagccgagactgagccactgcactccagcctgggcaatagagcaagactccatctc

SEQ ID NO: 110 - DNA, 2354 bp, Homo sapiens
tttaatcccctttaactgaatacattacctccctctgatatggttgctctgtatccctacccaaatctcatgttgaactgttactcccagtgttgggggagggacctggtggtaggtgattgaatcatgaaggcaaatttccccttgctgttctcgtgatagtaaattcccgcaagatctgatggtttaaaggtgtgtggcgcttccccactttactctctctgtctcctgtcaccatgtgaagatgttcttgcttcccctttgccttctgccatgattgtgagtcctctgaggcctctccagccgtgactcctgtacagcctacagaactgtgagtcaattaaaccttttcttcataaattacccagtctcaggtagttctttgtagcagtatgagaacaaggtaatacagaaaactggtaccagagaagtgtggcactgctataaagatacctcaaaatgcagaagcaactttggaactgggtaataggcagaggctggaacagtttggagagatcagaagaagacagaagatgtgggaaagtttcagacttcctagagacttgctcaataattgtaaccaaaatgctgacagtgatatggacagtgaaaatccaggctgatgtggtctcagatggagatgaggaacttattgggaaccagagtaacggtcactcttgctatgatttagcagagactggcagcattgtgcccctgccctagagatgtatggaactttgaacttgagagatgatttagggtacctggcagaagaaatttctaagcagcaaagcattcaagatgtgacctggtatttttctaaaagtatatgctcatatgtatgaagagacggtgtgaaatcggaacttatgtttaaaagggaagcagaacataaaagtttggaaattttgcagcctcaccatgctatagaaaagacaaacccattttggggggagaaattcaagccagtggtagaaatttacataaataacaagaagccaaatgctaatagccaagacaatggggaaaatgtctcccagggcatgtcagagatcttcatggctgcccctccagtacaggcctggaggtctaagagggaaaaatggtttcatgggccagtcccagagccctgctgctaactgcatccttgggacttggtgccccgcatcccagccactccagctccagctgtggctgtggctaaaaggggccaatgtacaactcgggccatggcttcagagggtgcaagccacaagccttggtggattccacatggtgttgggtctgtgggtgcacaaaaggcaagagaagaggtttgggagcctccaccttgatttcagaggatgtatggaaatgcctggatgtccaggcaggactccgctacagggccagagtcctcatggagaccctctactagggcagtgcagagggggaaatgtgggactggaaccctcacagagagtctccactagggcactgcctaatggagttgtgggaagagggccatcatcctccagaccccacaagggtagatccactgacagcttgcactgtgtgcctgcaaaagttgcaggcactcaatgccagcccattaaagcagctgtgggggctgtatcctgcagagccatggggcagagctgccaaaggccttaggaggccaccccttgcatcagcgtgccctggatgtgagacatggaatcaaaggatatgggagcttgaagatttcatgacttccctgttgggtttcagacttgcatggggcctgtagcccatttgttttggctatttctcccatttgcaacaggaacatttacccattccctgtactctcattgtaccttggaagaaactaacttgttttttattttacaggctcataggtggaatggacttgccttgtctcagataagactttggacttttcagttaatgctggaaggagttaagactttgggggactgttgggaaggcatgattgtgtcttgacatgtgagaataatatgagatttgggagaggctggggagaatgatatggtttggctctgtacccccatccaaatctcatgttgaattgtaattcccagtgttgggaggggacctggtaggaggtgattggatcatgggagcaaatttccccttgctgctctcgtgatagtgagttctcacaagatctgatggtttaaaagtgtgtggcacattccccttcacatgctgtttctcctgtcactatgtgaagatgtgcttgcttcccctttgccttctaccatgactgtaagattcctgaggcctcccccgccatgcttcctgtacagcctgcagaactgagtcaattaaacattgcttctttataaact

SEQ ID NO: 111 - DNA, 2044 bp, Homo sapiens
ataggatctgacttagtttcatcttgatgaacgatggtggtgcatacagtgtgtgcttgctggtctgtggtcagatgtgtatcagggcccctcccagctttgaagctcagatcccagtcctggattctcaagtatggccacactgtagcttgatgtaaacactaggtttagcttactgggtgccaggggcttgctgggttcagggaggacctaaacgaaatgtagagtgagctgctgtgagcacatggggtgggtggcgagtgcatgcgggtggcggcacttgggaccgcagcgtggttggggtgtccctgccattcatggcaggtgtgctgtggaaaggttgacatcctgactgttgtcaacagaccctcagagtgatcatttccaacgtcatgatctgccctttcagacattactacctgtgtagtaaattttgtactgaaattgttcccttaatttttagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacactggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaaaaggtgtgctgactggccacggtggctcacacctgtaatcccagcactttgggaggccgaggcgagcagatcacgaggtcaggagattgagaccatcctggctaacatggtgaaaccctgtctctactaaaacacaaaaaattagccgggtgtggtggtgggcgcctgtagtcccagctacttgggaggctgaggcaggagaacggtatgaaccagggaggcggagcttgcagtgagccaagatcacgctactgcgctccagcctgggtgacagcacgagatgccgtttt

SEQ ID NO: 112 - DNA, 1933 bp, Homo sapiens
ctcagggcggccccggagcggccgcagcgcggtggtctcggcccggctgcgccagagtccgcgcgatggagccccggccgcggcggcggcgcaggagtcgccccctggtcgccgccttcctgcgagacccgggctcgggccgcgtgtacaggcgcgggaagctgatcggcaagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgctactacctgcggggcctggtcagcggcctgcgctacctgcaccagcggtgcatcctgcaccgcgacctgaagcttagtaacttcttccttaacaagaacatggaggtgaagattggagacctgggactggcggccaaggtggggccagggggccgctgccacagagtactctgtgggacccctaacttcctggcccctgaggttgtctccagaaacggtcactcctgccagtaggacatctgggctctgggctgcatcatgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggaggggaccctccccacacctgtgccacctgctggacccggcctctgcctcctgcgcttcctggcctctgagcacgccctgctgctgctgttcagcaatgggatggtgcaggtgagcttcagtggagtcccggcccaactggtgctgagtggcgagggtgagggtttgcagctcaccctctgggagcaggggtcccctggcacctcctactccctggacgtcccgcagagccacggctgcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagagctggggggcacacgggaggtgggttcttgccttgtggcatgactgttcaacccagactttgctgggatctcttcctttttcattaaagacaatttgaaatgctgt

SEQ ID NO: 113 - DNA, 2675 bp, Homo sapiens
ttatgttttcagttgtttgccattttgtatcttcattacggggctactttcctgcctccctaaagtcatctttcccagcatgctgtttctggactttatttagtaccgtggttacctcctgcaggctgtgtggccccatccttcaccaaaatgtcacctcaattaattcggcggccatgagacagatccatcagtggcccgccgactcccgtcagcaggcgcccatgagtgatgggcacctccacgcctcccgcggcccccccccgccatgtggagtcagccgggcaggactcaccatccctctgggcacgagggcatctggctggcccgagtcctctcacaccttatgctgagggagacttcagcctcaggaggagaccccaggtgcattcactccacctagctggccttgttccccagccctgcactcagggatgcctcaggagagccaacgctctggcagggcagccaggtgccctttccctttgggccaggcccaggcagtggggacttaattgaatctgctcattcccaccccagctccacacagcacagcactgcaaatggagctggcagaagagctgacttctcatttctctttcctctcccttctctggtccataggtgtttgaggaactgtggaagagggaaggcaagactccagggcagattgtttcagaaaagcagcttgaactgatgcaggaccagggggcactggagcagctctgccactctgtgatggaggcccatcctcaagtggtgactatctcgggcaggggagagggccagagccagccccaggacatgcccaagagcctcgccatcgctccctgtggcagcccagaggctcttcctaagaatggctgacccagtttcatcaataattccctcactgtcatctttttagttaaggtcagaagagatgaaataggtggatattggaaaaacacaacttcttttcctataagaaggatgccacccctggagtttactctccatggaggtgtagtttaaaagggtgtcagcaagctcacgaaatccaagctgtgacctcccaggtgtgtcgccctctcccagggttggcatttcgaatctgttgtggttagcgctacttcctaaggacctcccagtaaagaaccagcaggtgtgccggcagagcagggagagtacaggaacttcagcttcatgcttctaagaggtgggaagaaaggcagaagggaaaagtattcataaattgtggagaaaatccctgacaggagcatgactgaaaaccaggtcattttgtgttcttagcacagcacaagacataaaagctaaaacgagtggcatccctccctccccaagtctaatcatattgtctagagatattttttcagtggggaaaaaaattgtcggcatctttttcagaataatacccacccacccatcagcttgccggggacacccacagctctgtaaagagctctcgataaggaaaatgagcctgcactgggcctccacagcctcgtcttcctgcctcatctgtggtgactgataaagacgtgccagtagtttcaggcttgttctgtggcacttgagtgcagatcctcatgtcattgcccttggagacgctgcagagcaggaggtcacgtggtggccctaagagtcagtggctatctgataggaattcagcacctcctggcttcctcactccccctgcccacacagcacactccccccgacccagcgctctggaagactcggccagtgtgtagatctgctttctgataaaggaatcttcttggtggggagcagggggagaaggaaagccacacatttcagctgaacatcactgagaatcagagaggtgtcctcactgattagacgcagtgattcatcatctcagagagattatccctccccagactcagtgtcctcggtcattgtggcgtcgcagaggggagggccctggctcccacgtgccagcttctctggctttcggcaatcacttcttgctcattttaatcagaaagcagagtagcaaaaatctcctttgacaggagcctagaaacctactcagaagtgaggcccctcccctttttctgttctacattttatgtctaatactagtggaaataagcggaatttaattttcagtaaacttaagccttagtttgggatttgggggcatgaatcccttcattttctcctcttaagtaagtaatttctgtccttctaggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggaataacaccttcttgtattaaggaattttaaactaaataaaatgtatgttggagatactgttaccc

SEQ ID NO: 114 - DNA, 1889 bp, Homo sapiens
tggctacatgctctccccgtgatggggccggagctgggctggggacaccccgcggcggcgacgtctgctcctctgattccttcaacgaggacaacactgccttcgccaagcaggttcgctctgagaggcccttcttctcctccaacccagaactggacaatctgatgatccaggcaatccaagtgctgcggttccacctgctagagctggaaaagggaaagatgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtggggatgagtttgaactcggaaggagaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcacccccctgtcccccccacctcccttctctaatttcttctttttttaatgataaagtcttaaaacacagaaaaaaaaaagacttcagagaattaggtagatgaagcactttatacagtatatatcttcagcttaaatttgttttgagtattttttttatttttaagtaggcaaagatttaaaattttttatttttagtaaatgtttgaagcaaactaaaaagacgtgggcaatatttaccaaaacaaaacagaacccaaaaaattgtacatcttgatcttagcaaatatccttattgtagagacacttaataaagagatggtattttaatatctgcagttctgaggtagggtgtaacttagttctacattgtgatttaggaatttttaaacctttcttcttcaggggagaagtgacccaggcctcgagtttagtgctaaagccactagtgtacttatgctgtcacctaaccaccacatgcgacatggaggcagaggctaaatataggggctttcttaagaaagtgagaggaaattagcaagcattattagtgtttgactactgctatcaagtgaattcaaaggaaacaggtttttatgccatatttaagttacagaaaccaggcatgtttagaatagtttctaaggtgacagagtgagactccatctc

SEQ ID NO: 115 - DNA, 3435 bp, Homo sapiens
agactcggtaagccccggccgcgcagggcgccgcgcgcagtccagccggcccggccctgccctgccctgtcctgccctgccctgccctgccctgccctgcactgcccggcccggcacgggcggcgcgatgtgaggcgtccgagcccggagcctccgcctagcatcagctccacgtagcccagcgccggcacgcgcgaggccccgcccatcttgcagggcagctgtgattagagaagccagggccaccccggagccagcctctgaggcttcacctcaccccgtttacactgctgtctcctctgcatagatttggctgactgaggacgcgacagcccttctgatgaagaagcacagctagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcaccccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcggcagcctcttgtcaagcttctgcctcgccccagtctatccccaaccccaaatcaagaccacctttcttcacggtcactatttattctttgttcctttttctttttgtaagaaacattcacaaaaaccagtgcaaaacc

SEQ ID NO: 116 - DNA, 1727 bp, Homo sapiens
catcatccccccgcaggactggctggaccgcggcgacgagtcagcacccatcaggaccccagccatgatcggctgctccttcgtagtggaccgcgagtacttcggagacattgggctgctggaccccggcatggaggtgtatggcggcgagaacgtagaactgggcatgagggaaacagaagggttccagcaagataaggtaaattataaacagaataaaagaggaagaaaaacacggcagagagtgaagaggagcaggtccgaggcccatagagcacagccgagccccggggccacgcacggagcccacagccgagccccggggccacgcacggagcccacagctgagccctggggccacgccaggcccacagcagcactgccagcgactggagtgtggcagtgtggcggcagcatggaggtgctgccctgctcccgcgtggcccacatcgagcgcaccaggaagccctacaacaacgacattgactactacgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgacggcctgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtttaggaggctggcacgactgcttcagcagagaccaaataaagagaggattaggcagc

SEQ ID NO: 117 - DNA, 1269 bp, Homo sapiens
cttcctcccgccccttctttggtccctacggacctggggggcggtggcggtcaatgccgggtcaaggtccgcgggcctcgcagatcgtagcccgggcgcacgcgatcagatgatcctgttgtggacggctaagttgtaggcgggatggctgagaaagcggcgctaggacccccgggcagaggctcggggaagggagtcaggggggaaatgccttacaaggtcgccttgcggtcaccatcattgcccgccgcccaaaatagcccccggcgccagctggcctgccctatggccgagagatggctgctgcctccgagcccgtggattcgggtgcactctggggactcgagcgcccggagccccctcccacccgcttccatcgggtgcacggtgccaacatccgcgtggacccctctgggacgcgggccacacgcgtggagagcttcgcccacggcgtgtgcttcagccgcgagccgctggccccgggccaggtcttcctggtcgagatcgaggagaaagagctgggctggtgcggacatctgcgtctcggtctgaccgcgctggaccccgccagtctggcccccgttcccgagttttctctgcccgatctggtcaacctgggccacacctgggtcttcgccatcacgcgccaccacaaccgcgtgccccgggagggccgcccggaggcggaggcagcggcccccagccgacctccaaccctcctcgtggaaccatatctgcgcattgagcagtttcgcattccccgggaccgcctggtgggccgcagccggccagggctctacagccatctcttggaccagctctatgagctgaacgtgctgcctccgaccgcgcgccgtagccgcctgggtgtcctcttttgcccgcgccccgatggcacggccgacatgcacatcatcatcaacggcgaggacatgggcccgagcgcccggggactgccagctgcgcagcccctctacgcggtggtggacgtgtttgcttccacaaagagcgtgcgccttgtccagctcgagtatggcttgccatccctgcagactctgtgccgcctagtgatacaaaggagcatggtgcaccggctggccattgatgggctccacctgcccaaagaacttaaggatttctgcaagtatgagtgaagacccacagtgcaccagagcacagctgcatcctggggccccagacctgtggctggctggtccgaagttggccacattgctgccagccaagaccagaaataaacagccgatgctg

SEQ ID NO: 118 - DNA, 1551 bp, Homo sapiens
atgcgggtgtgaatgtgtacatgtacacgaatgtgagtgtgagtgtgcatgagcgtgagcgtgcgtgtgcgtgcgagtgtgcacgagcgtgactgtgagtgtgcgtgcgtggaagcgcggcggggagcctggctgaaggcctgctgcctgcatggctgtcagagaaaaacagaagtgggagcctgctgcgggctccgagaggacttgatgggagccctggcgcgcgctgggcaccgcgcggagaacaatattgccaagaatatctggatggatggaggtggccggcaaatcgtcagaagcaactcagacagtccagaggaggatggtgcagagccagaggaggcacagggaggcggcaggcagatctgagaggcatcaccaaggcagcgctaaggaaggagggtagggacagtgactgcctcgggctgctgcagctcaggaggccgaatgatgcccttcaccaagcaacacacgattataggtttaattgttttcaaaagacttcgccctgctctgtaggattggcggctcgattggcattctgcctgcttcacagatgtgccagccgaggcttggacaaatgcagtaatttgcctgtgatcttgtagctagcaagggctgaaaccagaactagggcctctgctccaaactgagcgctgttttgactgttccacagctacttcccaggaccccacagaacagccaatgcagggaactgtgcccccatccgcttcctttgggactgccttcctctgtccccttggtgctcagggccctacgttttgcctctgttggggccggctgctgactggcactgcctggtgccctcctggctcctcccacagtttcccagacccccgaggtcccagcactcacactgcggggccgacaaacagcaggtgtccttgcgtctgactaaaatgacatccacttagtgtggtgacattggttattctgggttgcccagatgcttaactcgttgttgaatgtgagaactggggagaactaatttcttcttaattcatgtcctctttgttagtggaacaatttcatttcaaaatgaaaacacacttgggagaaatttttaaaaagggattctagtagtgaagagatggagaacagctgttcaggaatctttattcctttccactctgccccagctccctggatcctaccccagcaccccaggccatttaatcactctgttccctgccctttctgagctcttccttccttaattgctcataactagcatctcaacacttcatgattgtctcccagatacgggttggggttgtcatccagtgggaacctgggttttctagctggtgaagacactcctgcaggcatgaaccttgttttggtttggttgttactctctgtttccgcataccctccacagtgcttgagacataatagtagctcaacagagagggtgccgtggctcacacctgtaatcccagtaccttgggaggccaaggtgggcagatcgcttgagtgcaagagttcaagatcagactggacaacatattgaaacctcatgtctaccac

SEQ ID NO: 119 - DNA, 1873 bp, Homo sapiens
ttcttggggcttgttgggttgtccatcacaatagcatccccattatacttctccacttcctctttccctctttaggaatgaccccaaaggagccctgcattagagcacactgggttcatagtttaccctcctcactgcaccccaggaagacaagtgaagcctgggtgactccagagacatggaggcctccccaggccatgggcaaggtgaaaggtctgggaatactcaccatctaggagctcaggcctgcttggaccagacttcaggaaaacctgaagtgagtgcagactcactcagaggtgcacacacacacaggcacactcacacgcaggataaatgcccatgcagacaggcatgcactctcacattctagcacctggcaccctggttctggctggactcactgtgaaagactcagcctgtgtcttacttccctggtgcccatctgcaatccccccagggtctttggctattgatggtttcacagagagacctggactcagctctctggggcccctgggagatcaacccatggttacgattgacactagttgcctgggatggaccaattgacctcttggtggttcccatcagtgtctgggagacagtggtcatgatgcaggaagcaaggacccatgtggagctctgccattaagtcgatgtgggaacaatcaccctcgactgaaatatgggcacttctaattcatctttcctccagaacaacctgcttccataactggcagccctgccccaccagtagactatgtctaaagcttcctgtgctctcagggccaactgaagccacccaggactgcagactgaagatgggaactgtagccagcactacctggggctcaccccaccagccaccccactcccaacccagctcgctaggctttgccaagcaccaggccaggctcagcagcttgcgagccatgtaacatgccagatagatagtggagggaacatgtaactgagtaaccagcaccagagctgggccacacattttttgtttttcatgcagcctgtatttgcgggagggtggtggtattgatggctctgtgtgccccaggggtctctgtccaggcactctagtgcttctctggtggctgtccctctccactggtccatatttcaaacttcagtttggggaatgggccatcagcctagcatgccagagaggatccctcacaaacgactcctgagacccctgggtgcagctcgtacatgtttttagtccctttgggaccttggcttgcctcccagcccttcctcctcaggctctctggctggtccctgctgacctcgcactgaagatcctagcgcattcccccaggaaggcttgagatggcgaagaactctgcttggagaacccagctctggacacctgtctctgggctttggcagcaggaagctggccactggccttagccgtcagctagaatgggtcattttcttagcagccatgaatgcagaggtatttctggttagtctcataagaacaaaaccatccacttccccagagtcctcacacattccacccaaaaagcaaaggagacacaggccttcttggtcttcaggatcccatagctgtttccctgaacagggaagaaactttagccttgggttttctctccattccatgacacagggctccaggccactgcagcttccggacatcagtacccgataggtgtaaagtgcctactccctgaagaaagatctgaaagtatttttttgatgacagtggggaatatgtctggatttttggactcaatggcactaattatatcttctgaggtttatgtgtaaatatgattttgtgaaactaatcatatctctaaagaggaaaaataaactcctgcaaagctgc

SEQ ID NO: 120 - DNA, 2467 bp, Homo sapiens
tgaacgcccctcccgtaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtaagggcagccccgggccacaggcgcaagctcgctgcggagcccgctgctgggaggggtcgtccctcgcgcagctgcagccgccctggacccccagtggccccagcctcacggctgccgtcggcccgcaggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggtgcggcctgggctcccctcctccccaacggatcagcccggggcgggggcttgcgcacctgcaggggagcccagggtccgggttcgatccgacggcctccgccgcaggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacgtgagtggccaggtgccccaggcaagcactgtgggacacagcacctaccctctgcttcctggagtgcccagctgggaggacctgaatttctcgactgagggttgggaatgggctgggggtccagctgcagttgcaattgccgagcaagaatttttatttaaatacatttatttgaaccggcctgggggaggcttgatgttgatgggttggtgattaaagcctcccaaagccaatccttggcatggcctttgggactcaaaacacaggatctgactggtgggcacaataccatcttgaacgcccacaaaaaggtttggttttgttgccaaagggcaggtggctccaggcagggctgatggtggcagggtggggtgaggacaggacaagagatctgggtgtggaaggatggccgggtttctgcagcagcaggaggaaagggtgggagcacacaggcacagaacactgtgagcaggactgccaggccagtgtcacaagcgctaccatctgggtgtagacagacctgagctgacaaagctgggggagcaaggccaacggctttaaacacaagctcaggggcttggggtttatcccgagggcacagggcagccatgtagggtggagttggcatgagttaagcctgggctgggtgtgtagactggacagaggtgggtagggcaggcagtgacgagctggtgtgcaagagactttagggccaggcatggggggacagaactcccacctcgttcgtgctcccaccctccccagctccaccgcctggtcttcagtctccggcatagcaaggaggaacgggaggacctggatgctgatgagcagcaaggctcctcactccctgtacagaatgggtgcccagagagtgccatggagatgaatggtagggcaccatgctgggaggtggggctggaggagctgagttcccgcaaactaactgcagggcctcaatttccctcagagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtc

SEQ ID NO: 121 - DNA, 1667 bp, Homo sapiens
agagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccttggcctatttagattccttcctctcacctggaccttcccatttcaatcatgcagatggtttctttttgtaaagagttccgtttgcctttcaatttttagagaaaataaagactgcattcatctcat

SEQ ID NO: 122 - DNA, 2520 bp, Homo sapiens
ctctgggccgcccctctcagcccaccgtcctcctggcagtgggagagaagcagagacatggctgggcccctggcagggaccccacgggccaggccagcgttctccttcccacaggccttgtctgtgtttagacctgatttctatctcctgctgaaaatagttctgtttaagaatgtatggagggccgggcgcagtggttcgcacctgtaatcccatcactttgggaggccgaggtgggtggatccctgaggtcgggagttcgagaccatcctggccaaccaacatggtgaaaccccgtctctaccaaaaaatgcaataattagccggatgtggtgccactggcctgtagtcccagctactcgggaggccgaagcaggagaatcgtttgaacccaggaggcggaggctgccgtgagccgagatcatgccactgccctccagcctgggtgacagagtgagaccctgtctcaaaacaaacatgcaattctataggccaaggcattcatggaccacgttcgtcaatgcatgttttcaaccaatgtgtactgtacgtgaggtgagtgttcacctaactgaaaactggaatgtttgtgggaatatttcagaaacaggaaggcccaggtcccacgggaggcgttgggggccggccgggtgtgccgtgccttttaccttcccagcccctgccctggacctgaggccccgcctgatgggcccagccctcttcttccctgcctgacgtgtgtgcccaagttagctccagtgaggcctctgctgtggctgccccaccctaagaggcagcaaggaaggtgggtagcccgggggtccagctctggaccttggttcactcacacctccccacgccctcagtgctcccgggcacccacacgtggcctgtgcatcctcctgtcacagcagcctgcagaccccacacccctcacggcccaggctcagcctcagccttgcagcctctcgtctccgacgggggggcccctctgcaccctgccctctgtggtggacgccagctcccagccagagccagctatcagtgaatgaaggtccttgtgactcccacgtggtagcttctgtcaagggcccagtgggcagaggccctggctgagtcaacaaggctgacaaggctgtgttctggatgcaggcccggcagatgtttgagggggaggtggccagcctggaggccctccggagcacgggcctggtgcgggtgccgaggcccatgaaggtcatcgacctgccgggaggcggggccgcctttgtgatggagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggtgaatgagtggcaggatgactggccgacctttttcgcccggcaccggctccaggcgcagctggacctcattgagaaggactatgctgaccgagaggcacgagaactctggtcccggctacaggtgggcacggcagtgacttctctgggaaagagctggtcctctcatgatcccgccgcatttgtgcgggttcatctataaaacggagctggagcagggaacactgagtcctggagcacacatcagggaggaaggggggcaggggcgggggttcccccaaaagggagtccgaaaggagtgaggagtgaagacacacttggctcctcgtgcccctctccactgctaggtcaccaggtatttagcctcagactttcctcatgtgaaacacaggtgcttgtaaatggtggtgtttaccatgattactgttcttactatcagtaacacttgtccactccattgtgttcctctcccatgggaagatgtgggtaccagatgatccagaatgactgatttcaaaacataactctcggccgggcacagtggttcacacctgtaatcgcagcatttgggaggcctaggtgggcagatcacttgaggtcaggagtttgagaccagcctggccaacatggtgaaaccctgtctgtactaaaaatgcaaaaattaaccgtgcatggtggtgcatgcctgtaatcccagctactcgggaggctgaagcaggagaatcacttgaacccgggaggcggaggctgcagtgaggggagattgcaccattgcactccagcctggacgacagagtgagatcctgtatcaaaaagaaaaaaaatcaaaatataactctcaaaatgttaaaaaagaatgtgcatgtcaatccagagtgagtatacatcaaagagacttgaactcattaatgaagaaactaggctgggcacggtggctcaagcctgtaatcctagcactttgggaggccgaggtggatagattttacctgaggtcaggatttcaagaccagactggccaatatggtgaaaccccatctctact

SEQ ID NO: 123 - DNA, 2179 bp, Homo sapiens
ctggccgccgagggtcgcggcgcccaggctgccggagccgccgccgtctgggctcggatccgggaagctgcggcgctgccgcggcagcggcgggcccctcatttgcatgcgattagcatgcgcccgcccgcctcatctgcatgcgcattcctcgcgccgcattcctgagcttaaccccgccgctgccggcgtcgccgcaccagctcggacgcactgccccgcggggccgcggctccaggtgggaggaaggcgggcgaaggaatgtgcggccagctccctccccttgaccccagatagctcccctgggccaaacgccgagaggttttagagtttctggacggggaagattgcaaaagtctccgcaaccttctcaacctctttcgtcttctagggaaaccacaaaactttcgagaggaaaggggtggcgggcggggagctctcctccggagaaaaaacctcaacaagcggagagggcacaaaggctccccacgccacgccccgagcccctccggcaccccaagggcggtccggggtggtgggaaagcgccaagccctgggagtgcgtcggtgggtccgggacggcggggcctccgccagggctcctggccctcgatgacctcggctgagaccgcgagccgcgcggcggaaagcggaggaactcccgtccggccctgtagccgcccgcaccgcgccccgtcacccgccgccccttcgcgtccgggcgctccagccgcggggccccggaagctcctggtccctggcctcccctgcttggttcggggcggttggccgtggacgcgccccgactctagtcccttccgtccagccgcccgccccaggatgtccccccaccgcagccccgccgtggccaggaggtgtgggcggccacgccggagggacccacggcggcgccggacgcccgcccttcctaggccctggcccggccggggtgggccgggacgttccctgttgcataggcatttatttattcagcagctactacgtacgtgctggcccgcactgccgagggaccggacgcctgccccaggcgggacaatgccgggtgcagcgctggcggggcctggacgccaagcttcagggtccccagcccctcagtcagagggggcgcctcccaggccctggactcctctccagccgggtctacaccaccgtcccccgtcatcttcttctgggttactgagcagcttcttttaaaatagcaacaccgaggaaggccccgaagcccagtcttgcacctcgtggtgtgaagtcgtttaatcctgcccgctaatgcgtaaggactttccaccgtgtgcaggactccgcgctgggcaggggctctcgcagggtttgaaccgacctccgcctcccctgcgggttcacaggcctgcgaggaagtcgcgtgaaggagattcgctactgtgtgaggctggcctgcgcggcgtgggcagtagctgtccggggctggggacagctttcggctccccaggccatcccgtcggggcatctgcggccaatctcgaaggtggagaggctcagggttggaacagacttcacggaaggggtcctagaagaggaaaggggtcgtgtttgcccttagagcagtctgggcgtgaagcggaaactttaaaccaccagaaactctggagagcttggagcacctgggaaggagcaaccagagtgggccggaggtagggaaggaaggcacccacggcgaatttgcccgctttgaccgcatttagggcggccgcttgtgcagccagccttctggaaggtaggctttgcgcttggtgaagagaagcccccacctccggatctgtgttccgccccagtccatttatcaggaggtgatcacacaagtcaagcttctctagttcccggtggaatgagacgccctggtggggtcttaaggttgaacgtttgaatactgtaaaaaagatgggacctgcctacaattaatctctcacactactgagcgaatgtgcgttgttttggacttccctaaattggcccaaatgcatagccaacacttgaattgcggtgtactaacaacatcattcagcaccaaaccaaaccattcttatttaaaccttgcttcctagcttatttatttcccaaacaacttgaaaacatttgttatactaaaatgtctacatcttactattaaaaaaaaaaaacc

SEQ ID NO: 124 - DNA, 1609 bp, Homo sapiens
tcttttcagtactattttattttcagaattttttctagccacacttttcttctcaagcacagcaggtagcctttgcatagctatgagagtgacaggattcttgtcaaccagaccatagacgcctacccagccaggtgtaagaaggtccgctgtgggcagagaagttgatgagccagcacggtcagtcctgtctttcgctagcagggactattgactgctctgtgccagacattttgttaaaaagtggtgttatcggcctggcgcagtggctcacgcctgtaatcccagcactttgggagaccgaggcaggtggatcgctcgaggtcaggagttcaagaccagcctggccaacatggcgaaaccccatctccactaaaaatacaaaaattagccagacgtggtggcgcatgcctgtagtcctagctacttgggaggctgaggcaggagaatcagtgaacctaggaggcagaggttgcagtgagctgagacgatgccgttgtactccagcctgggcaacaagagcaaaactccatctcagaaaaaataaaaataaaaataatggtgttaccaagacatagaaggtggggtccattctttgaagtgaccactcattgagtaaattaacatcatttctgtttcatgccattgaagagctgtgaataataatacccttgtgtcaggcttcctgtggtctagcactgtgtcccgtactttatagtttatttcctttaatactcatgcccatctagggtagtaggtaccatggttgttcccagttgatatatgacggaatcgaggcttagcagaataagaagtcacccaaactcatacccactggtcagcagtacagctagaattcaaagccacacttgtctaggtccaaaatctgcacccctaattaaccactcctggtaagaagctggttataagggctggtcaagtcagctatggaagaattctcagaaagtgactctaaaggtgttctttgaaggttgtgtaggaattcaccaaaactggaaggagacaggccttccttgcagggaaaaggaacgtaaggggcaaagttacagagacataaaaactcacaccatctttggaaaaaggagactcattttgagaagccaaagagtaaggttaagtgagaactctggacatttgggcctgtgggtattgggcagcagcccctgacatgatgactcgtctgtgtgacagcagaatgaatgaccacagcagagccagagggcctttgcagccctgttggtctcaagtttactcatgtatagcacatgcaacctgcattaataatcacttctttggaatgttttctacctggaaagggaattagtggatgtaacagttcattccccaaacataaaattttccttgacgttttgattgttataactcatttaagtgggaaagtataagatttgatatctagccctgaagactcatcattgagcacagtgctagaaagaaatgcctaccaggctaggtgcagtggctcacacctgtaatcccagcactttgggaggccaagacaggaggatcacttgaggccaagtgtttgagaccagcctgggaaatacagtgagaccttgtctctacc

SEQ ID NO: 125 - DNA, 1667 bp, Homo sapiens
agtctgtccttcgggtcctcagcacagccgtgccggtgaggcgggcggcgggggaacgcggctgtcccggcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggtacccgcagcgcggagcgcgcccaccccgcctcccgccggccccgccccatctgctctgacccgccctcccccgccaggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaaggcacggcccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 126 - DNA, 1642 bp, Homo sapiens
atgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttctgtcatttgatccatgttcaagacccttgaggtattgtttcatcatttctgtattgtctttcaataaagaaaacaaacatgtgcaaccag

SEQ ID NO: 127 - DNA, 2356 bp, Homo sapiens
tcggtgaagtagggagggaaggcatgctcatctccattgtacagatgagcaaaggaaggcccagagagaaggggcttgcccacagactggcacagatataggtgccaagctctacaacccccagcccagtacttgttctacggttctgtttcttacgtgcagctgggcagaggagaaaatcagaagctgggaattctgggaagaaagaatcccttcggacctggaacttccttctttcctccttctctttcttccttcccttatgctggtcactgggacaccatgatgaacaagatacaacccaggccctcctagagctcacagtccagtgaggataaagacctctaatcaggcacttattagctggggtactaaggccaggcgggaggcgcatagcagagacacctgacccagcctgggggaatctcggtggtctgcctgtaggaagtgacaccttgcctgagaccgcctccattcctactaacctggcttggttctagccccatgtcctccagatggctgcctgctctcccaaaggcttcaggtcctgatgcctgacatgagttatcatgtcctgtgtgcaggcccagctcctggctcatgcacaggaggcactgagcaactcctggtgcctagtccaggacttcggctccacccagatagggatggtgggttgggggtgaactctcctcagtggcatgcacctttttctgtctaggaatccactctgagtgatgactccacgccccccagcagcagccccaagatccccagtgggccctggcaggaggccaaatgttcttacccctaccacacgctgtctcagtcttcagatgaggtgagcaaggctggcccagggtgcccacggagtcctgacctctgactctgcaaggtgctcaggtcacaggccaagcctccccctcactctccttggtctctgcccagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaaggtgggtcagagtggaagggccatgacccagcccagttacttgaggtgactttcaaggatttgaagtccctcatcctgacctttgaccctcagcccagcctcctgggctgaccttttcactccatctgtggccaccaccctgacctctgacctctaggcaaggtccttggtctaatcttttgagttgtagcatgaatccctagtttgacttgaaactctagtccatgacttcagtgtgaccttcaagctccagccctggtctccaggctgaccttgccctctaggatgacccttgatgcatatgagtgtcctggtatcatgggaagccacatctccccctggtcagcttggtctgattctgtctcagaggctagtggtaatagtgggcagggggaggctgtaggaagggggtggtggcctctgacctataagctgggaggttcctggcctgtctcctgctctctgctgagttgcttggggcagggatggtgaaaagagcccccaggaagtctctggaagtgaggagggtccttgggcactaactgtgtgaccttgggcaagtgactccccatctctgggcctcaggaggttgggcaggtccgggccaaggctgaaatactgagtggaggaatggtgggggaggaggaggaagcgcctaatacccccaaccctcatctttcccaaccacactcattccaaattcttgctctgggggttctgatccatgggcaggtcacggtgtgggaggcggaggctccactccagggaggatttggagctccacagagtacacctggggcaaaaggagcctgggcgtgggaggccaggactgggaaggttctgggactctctccctcaccccggactcctccccagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggact

SEQ ID NO: 128 - DNA, 3105 bp, Homo sapiens
aatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagcccccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtg

SEQ ID NO: 129 - DNA, 3110 bp, Homo sapiens
attttctgtgtcttctaagttcgcttgttttagctcatctgtccgtcatgttcctggtatgttttctagataaatggcttacttttcacccacaaaagccataatagctgatgcttctgtgtagaaccaagtttcattttgactcaagagctggtacattgcaccccttcatcaaatctctgtgtccacaatctcataaactatcaaattctgggtatttgatgagagaaagcttaatattgaagtatctctcctatgaggtgttagaactatttgcctacaatttattggggaaaaaattgctcatttgtgtacataaacctaggacagagcacatagggaaaataacattccaacacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagaggccccatctgaatttatttgcagaacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtgccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatagatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgcgagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcactttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgggtttcataggaggtaatcaccagacaactgcagaatgtggaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatc

SEQ ID NO: 130 - DNA, 2102 bp, Homo sapiens
cggctgtggactccaaatagaagatcattgatgcccaggagaagcgcattgcctcgttggatgccgccaatgcccgcctcatgagtgccctgacccagctgaaagagagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttttacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctatttt

SEQ ID NO: 131 - DNA, 2234 bp, Homo sapiens
attacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagagggaagagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcat

SEQ ID NO: 132 - DNA, 1610 bp, Homo sapiens
agctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggacggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaacttcc

SEQ ID NO: 133 - DNA, 2682 bp, Homo sapiens
atctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcacccacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgctgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacggctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaacattgtagcaaccgcgacacaaaccattgagtacactactgcccagcaaaagtacttcagcaactacagtcctgtgattgggttttacatatatgagtctatagaatactggaacactagtgtccaagaagatgttctagaatacaccaaggggtttgtgcggatatcccggtttgagagctatttaaattaccttcggaaactcaatgtatccactggcttgcctaagaaaaatttcacagacatgttgaggaattcctttctgaaagcccctcaattttcacattttcaagaggacatcatcttctctaaaaaatacaatgatgaggtcgatgtagtggcctccagaatgtttttggtggccaagaccatggaaacaaacagagaagaactctatgatctcttggaaaccctgaggagactttctgtcacctccaaggtgaagttcatcgtcttcaatccgtcctttgtatacatggatcgatatgcctcctctctgggagcccccctgcacaactcctgcatcagtgctttgttcctgctcttcttctcggcattcctggtggcagattcactgattaacgtctggatcactctcacagttgtgtccgtggagtttggagtgataggtttcatgacattatggaaagtagaactggactgcatttctgtgctatgcttaatttatggaattaattacacaattgacaattgtgctccaatgttatccgcatttgttctgggcaaggatttcacaagaactaaatgggtaaaaaatgccctggaagtgcatggggtagctattttacagagttacctctgctatattgttggtctgattcctcttgcagctgtgccttcaaatctgacctgtacactgttcaggtgcttgtttttaatagcatttgtcaccttctttcactgctttgccattttacctgtgatactgactttcctgccaccctctaagaaaaaaaggaaagagaagaaaaatcctgagaaccgggaggaaattgagtgtgtagaaatggtagatatcgatagtacccgtgtggttgaccaaattacaacagtgtgataatgtctgcttggcatattttcaccttaggtcttatcaagaccaaagagattatgttaatgaaacaattaaattcaaagttcttcccttttttaaagataggaaacaggcattgcc

SEQ ID NO: 134 - DNA, 1974 bp, Homo sapiens
cgtggagaaaacgagccagtgttcagaccagcgggcagtgacgccaggatggggtcccccaggctgggacgggggccctgggtgtcctgaggtttcctgttctgaaagaggctttcatgttgtcgagcaccccttggggtcacacatctgggcgaagagctagaactgaatttgcacccagggctcctgactccccgtccagtggcctttccacaaaggaaacacgttgtgtttcctctcccgggcatccgtgagatgggggccagactgcaaggcacctgagacgcaggatcgcacaggttggaaaaggctccgcaaccctaagaagctcttgcgaaccgcgatgctgggagattcctaaggaatcatccagctgcgggaggctcagcccagtcctccccaccccgcccccatgcaggagcaaagcgcccagaggtcaggctggaggcccccgccggcccctcgccgctgattcagccttgcccgtctccctccgcagtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccacagctcagtcacccgggcccagagtgacagcagccagacgctgggctcctccatggactgcagcactgcccgcgaggagccgtcctctgagcccggcccttctcccctgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacagggtaagtctgttcaaccagaagaaccaggagggcttcactgtctttcagatcaggcctgtcatccacttccagcccactgtgcccatgctggaggacaagttcagatctttggaatccaaagagcaaaagctgcacagggtccctgaggcctagagcctgccatgggctgggtgagatgaggggagacagccatctcaaagctctcctgggaccctggaggctgccaagggccacacgcggggcccaggagcccacctggcctccctcagggtgctgcctgcctccagggaggcgacgccaggccaggaggccacaagcttcagacctcaaagcccagagctggcgcctcttctcgccctgctcaggggagggtggtgctcgtggctgggttttctttttaaccatttttacaaaaaccagcctgtggcccagcttcagcagggtagagtgtgggggggccagctcagcctcttccgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaatctagaggtgggtgggagggtcctagagggcaggggaacaaccattttccaaccttggctttaataataaaaaccagctgcactgag

SEQ ID NO: 135 - DNA, 1400 bp, Homo sapiens
agtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctccgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcagggccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattc

SEQ ID NO: 136 - DNA, 1873 bp, Homo sapiens
gaaataatcagactcaaaaagacaactactacatgattccacttaacagagcagctggagtgcatcccggggacttgggagctctggaaagaggagcaggaaagggccatggccggaggaggcctgaaaaagatcatctctgccacagagaagaagctggctcggatgctgctggcccctatggggacagggagacccggggagacaactgtattcattcaaggaggaatgggtggtgatgcaaacttgggtggaggccacagggtgcagaagacaggacacagcagagagagatgtaggacatggaagggacagaaaggagtgaccacaggacataaaggggcaaggaaagtggaagcatgataacatctgctgggcatccggctgaggggttgggtgcctagggtgcccttccctaagggagaaccccaggagcagattcagagaaaaccgcccagctcactccagcaagaatcagaaaaggaccggttaaaggagagggtaggaaggtcaccaagctccaagggccctcatgaatccggcttggaggccacagggcccagggcaaggacaaaccacaggcacaggacagctccggtcaagatcttctggctactgcaggaggcagaaaccacaccctgcaccctgcactgctgaggctggcgctggagtccagaagcttctacaccagaagcttcggtcccccatccctgctcaaaaaattaaaacaaaaacaataacaaatcggtgtcatgcaccctctgcttcctggtgctgttcgggaccctgagtctttcacgggagcacctgatggggaaagcctggacccgtgtcggtgtccctcctgcaaggagtgctgggaaaatgaacttcccagcttcctccttgcgaaggcagaacattccccatgtgtactggtggcatttaaaaactgcagggcagccagagaacatggactgtgttccaccgggagagttcctggcgggatgtcccggtgcagaagcccgtcccaagagattattccaggaaaagaagtggccctcagtgtcaaaggatgcaaaactaacctctgagttcctggcaggtttagcaataaaggaggatgttgctgatctcagtacaagcaatgttagagaaaggggaagatggaagtggacaaggacgagtgagtggaaggtgacaaatggaagcaaagaaacgtatccagaccattgaagatgcttgagcgagaagaaagaggcggtggagggaatggaagcccgaggaagtcatatgttgcaataaggggcctcagagcacgtgtagagtgtggagcagagcccttgcagaggggctgtggaaggctggcagggtgcaggtggccccactctccgtcaccctgaggagtgtgtggtcagagttaaagctcagtctgtttctgggatcaggctttcacaagctccaaaagattcaccgtgcagaactggacgttctagagaaagaccacgcctcctcctgcaggtaactcttcattcaggaagcagctcttggcttatccctgggcttagtggaattggaatacctgaccataggacaccaagggctttaggacctgagtggcacatcgtgtcctggtgacatctgagttacctggggcgtgcacagcagcctccagcatcccagggagagctgtgtatggggtcaggctcaagcaggtcccagggcaccagtgacccaatgggtgaatcagactcccgtggcacctgctccttctgtatctccctctgccatatatatgagctcatgggaagcactgtaacctcttacagaggaggaaagttcatggacttctagcttctagaactgtgatacaataaactcctgttgcttatct

SEQ ID NO: 137 - DNA, 2048 bp, Homo sapiens
gttttctctccagtcattcggctcagtaccccggttccggcgctgccgggtctcggttcgggttcgttgccccggtgccgggaccgggccggtctctccggccgccccagccgggcgcagcagccggagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggaggg

SEQ ID NO: 138 - DNA, 1809 bp, Homo sapiens
aagggtggcaagtgccaccttcgctgtgctagagttgtgttgtaggaattagtcagggagttgttgtgaaaaaaaaaaccccagtgcttgtgagggaactcaaaatagttaccagaaaaataatatttgccaatatgacgtgtatattgctcagcacactctgtatctcctgtccttaaaatcctcttgtccccggcattctgacacactgggctgccgtccggtgtcaagccccggcgcaggcttgctcttcttttacaatgaaaggggtgaagagtgagggtctcacagttccttacctcaaagtccctttaggtccttctggtttggaggaagtggagcctccacgaactctctcttactccgaccattcaggcagcaaagtctctgcttacatcattttggttgtcaccttggggctgagtgagaagtcttttgtaaattaattcggcgtgtgctacatgagccataattattaacagaacaggaatatcagaaacgaagttgttgatcaggcccactgcgaccttcctttctatctcagggtttaaaactgtgaggaaggagaagtatgaaggaaggtagaaaatgctggtgggtctccgtgtttatgagtcacagattttgaaagctatcaggaaatgactagagtggatcctggcactgattccaactctttgccagctaatcttaacatttagcagaaagctctagcaacatgatcttaattgtatccagaggatttgccaatgtatgttcagtctctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctaggcgtggtgggcagtataaagaaatctgtctccacagccacacaaccagagggtgcacatgacttgatccctatgaccaagtcaagttggtgttgcccaaatcgcagtttgacataagggtcccacaggcttccccaccccccgcccccactcactgccccagggaccaacttcctaccctcacccaaggctttagaggacctgtagcatgtctttttcaacctgtcagtatccccttctgcttaacacacccactgagaaaaccctgtttgtagttcactttgactcttgaatgtgtcactttactggcaagagacttcctttgatttctactgtttacaaataaaactcagccagtctcattctatatcccaaacgtactgaatgaaactgattttggttccacaagcagtgtttgggtgttgccttcctgaaggtgaccaagcttctaaagctcgtcccactggcctctgtacatttccctgtggttctccgtccttccctggcgagggagctgggactgaagctttcccgctgtttccctgcctgcaaaagcagccccaagagctgcgcattggcttccctcagcaatctgtcctgtctgtgctcccattcggtccacatagctttctttgcctctctgaggcagacaggaagtgtctaattacgattttgtggcctgggttttgttgcataccacagattgtctatgtaacatgtagcgcacacctctcttggtgctatttcattcctgctgtaagagaatgacaaaaatattcatgtatagccaattgattgtgacgtgcttgtggtctgtgcttgctcagaaaaacaaacaaacaaacagtttttccaattataaataaatgctaaagacg

SEQ ID NO: 139 - DNA, 2585 bp, Homo sapiens
agaagtgccgagtcccggccgggggcagcctcgccgccgctcagctcgggaatccctgccccccaccagcacctcagtgggggatactgcaagttcaaggtggtttaaggcgtgaatgaatgaaggagcaagcagtaagccccgacagcaaggccaccacagccctcgccccacagggacgcctgagcaaggacccaagcaggggacaagcaggctcaccccgcccttgcggggctgaccacgaggccccgtccggtggaacacgccatgacgatctgaacctgccccagccccaggactctgagtgcagcaagaggggagccgggctggagagtggggagcacggagactgtggcctggatggtgccagagcaaacaggagagaggctgcccaacgcagaggctgcagcacagaccagagggtcccggggctgactgggtgggggcagctcccagcgagaggcccctgggatttgggtaagtagaggcacatgcagactctggccacagggcacctcgcgcacgaggggagttcaccacacaagctgagcggagggcggacgcaggagagcagcggtttctcggaagccaagggcggtcatggagccccacgccacagcgcttcccacggggccacaccatccggtctgcggagggggctgcattgccgggaaggaccatctgattctggattccagcctcaccctgggccaccgctgagtgtcccaagtggccccttagcccccagggccaggcggcatcccaatcccctagggatgtctgtgctcagaatgtggcacacacgccccggcagggccatcctcctcctcctgcacccgccacagccgtggattcggggtctctatcgtgggcagaaattcacacagtcaaggtgagggtcccaggagcagctgtgaccaggccccggctgccagggagagggggtcttcagccgacggggcagacaccctgagatggacccttgtccaggggagggccctgccacccacaattccttggcattcctgcaccagcaggacgggctgagggaggcgcctcaccagtgccagcgcccagcatcactgtgccccggtggagggggaggcccttccgagcctgggcctgggtgtggatgagggcaggtctctcacctctctgacctcagcttcctcaactgggaaggggggccacagcacccccttaggggtgatgaggaagtgggagctcagggaggaccccgggcagggctgcctcctcacctctcttcggcctttggacactggagctcagaggaccaagtgaatgaatgaatgactcgatcaatcaactgatccatgaatccatggacccctgaacagctggacagctgggctgtgggcaggacaggggactctggctgaagccgcgttcatatgtgttcagctttgtgagtggggcgaggttgagggcttattcagtgggggaggtgcacggcagggccagtacccttggagggtcaggccacaggggcggggacacctgccaggatgcccaaccccagaggcagtgggagctgttggggagccgtggtcccagtcagcggtggcttgatgagggctgctcccacttcatccgcaggattccagccgcagctaccccacacccgagctgtccctagtcgcccaccgcggccggacaaagccccagcagccaaggtgctccgtggggagggtttcttgggtttcttgaagccagtatttcccatagtatcttacgtcccagcagaggcctccactgtgcccggaccagcggcccactcagtgagtcgagtgtgcacctggcacccctctttctggaaatccacgaacaatgggctcccagcagaggactgaggctgagcaggccacttccctggagctgaccccacagctgtgtaggtacagggtggccgtgaacacttagggctctctcgggctgtgcgcttcttgttcactgcaaggagcagggtgttggctcctgaccaagccctgtcactgctgcccagccacacgtggggccccttcacccacccctgaccacctcatgcaggtgaagccactgtggaaacagcctggcagtcccttgaaaaatgaagtcataaaccccagcaattgcactcctgggcctctgacagagcttgcacgtcccctccaaagctcgtgttaagctgtgagccccagtgccggaggtggggcctggtgtgtttgggttctgggggtggatccctcatggctgggtgccatgaacccactcaccacagtgagttctcacgagatctggttgttgagaagtgtgtcatacctcccccacaactctctgtcttttgttccggctctggcaatgtaacaagcctgctcctccttcgccttctgccatgactgtaagctttctgagggctgaccagaagcccagcagatgccagcaccatgcttcctatacagcctgcagaaccgtgagccagctaaacctctcctcataaatcaccgagccccaggtttatctttacagcaatgcaagacctgactaatacagcaccagctccccaaaataaaaagaaatattcaaac

SEQ ID NO: 140 - DNA, 1906 bp, Homo sapiens
aatcccggaagcgcgcgcggccccgcccccgaaagtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttgatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 141 - DNA, 2431 bp, Homo sapiens
aacctcttgaatacagttcgctagtacaaggggtcttcaggaagttcatggaaaaatacatattatgagaaaattgtgcatgatatcacattttttgcaccaagataaactggtacaaatccgttataacatgtctgaacagggtttggtttgaggcactcagatgggtaagacatgagtttgaaaagagactcaatcaaggcaatgtaaattctgctaaaactgaaacaagaagaaacatcaaatttgcgatgagaccagatgctgtggctcaggcctgtaatcccataattttcagaggctgagacagttgggtcacgtgggccccggtactcaagaccagcctgggcagaatggtgaaaccaccttctctacaaaaaatacataaattagctgggcattgtggcacatgtctgctggttcagcttctgtggagtctgcagtgggaggatggcttgagcctaggagttcgaggctgcagggagccatgatcatgccattgtactccagcatgggtgacagagacagatagtgtatcgaaaaatgaatctggtaaagtttgggtagagggacaatgaaatcattgatgctttatgaaaaggttatggggacgattcccaaaataaatcaccagtttgtaaatggaaaacttattttaagttgggacaagatgatgttgaaagtgatgcacaggacaggtgtggtggctcacacctgtaatcccagcactttgggaggccgaggcaagagcatcacgaggtcaggagatcgagaaaatcctggctaacacggtgaaaccccatctctactaaaaatacaaaaaattagccaggcgtggttgtgggcgcctgtagtcccagctactcaggaggctgaggcgggagaatggcatgaaccgaggaggtggagcttgccatgagcagagatcatgctactgcactccagcctgggtgacagagcgagactccatctcaaaaaaaaaaaaaaaaaaaaaaaaaaaagaaagtgatgcacagagtggcaggcagaccatccacataagttttataggtacaactgtcaaagacgacactggagaagagccaagctggatctataaggaattgcatatgagatggcacacatattcatgctgtctgaagattcagtcacgttaccatatcaagctgaaaatgtcaccactatctggagagttggacatgttttattgagaatgtattttttttctctggatctgttatgaacacctttgttggcttggttcagtaataaatatgtgagacttttcatttaaaaaaagtcaaatgacttaattctgtattttaaattctgttttgtttgttttgtttttttgagatggagtcttctgaaaattttctcatcttctctaacccggttcatgacagacccttggactttactgttgtggaaaaatctatataaaacagtatcagtgtgtcaaagcattatggctgtcacaagcttgtgaaaggaaaataaaaattactaagccaaagagaaaagtcaatctgggaactgcgtcagacaaacctgccttccattttattcctaaacaagatagttacaaagattttttaaaaagctacatatgcccctcccaaaccgggaacctcaagatctccaccctaaaatagttctgttgaatttcaccctggcgatgtaaactgagagcttatcttcacagatgtgggaaagagcccatccctctgcacacctgagtcaaatgtctatctgattgcttcccttgccctatttatgtaaaaatacagggtccctgagccagcctaaggcataagtgacttgtccctcctccctgctcacatataaattgtgtatttagtgaaaggctgatcaaagattcaaagaatgttatttgttatctacctgtgacccagaaggtccccaattccagttattccacctttccagaccggaccaatgtatatatgtactgattgctgtctcgtgtgtctgtaaaatgtgtgaaaccaaactgcagcctcaacaccatggacacacgtcatcaggacctcctgaggttcgtgttaattggccttagactctccctgtccccagacccaggacgcatgtgtttcctttttcttcatttctattaaagatgggtctcattctgttggccaggcatgagagcggtgacaggatcagccctcactgaggcttcgatctcctgggttcaggggatcctcccgcctcagcctccaaagttgctgggaccatagccaggtgccaccgcaccgggcaaatttttgtgttcctagtagagatgggctttcaccatgttgcccgagctggtcttgaattccagggctcaggcgatccagccgtattggcctcccagggtgctgggattacagccatgagccaccatgaccaacgtgtttcttaattt

SEQ ID NO: 142 - DNA, 2066 bp, Homo sapiens
ccttgccctggcatatattgtgccttatttatgctgcaaatataacattaaactatcaagtgaaccactgttatgtctgatgcttcactcctctatccacagcccccattgtccccttttctgggaggtcactggcctttcatgtctgtcatcttcatcactcccccatttcttaggacagaaggaacagggatttttgtctctagtttttatacatgggagatacagcctagagaaagtggatgatttctataaattacaaagtatgacagaaggcccagggcagagctcctgtggactgccttggagacaagggcccttggcatcctggcagcaagtactcacaggaaacttagtatgtgctttatgtggatggcgggtgggagagttgctgatggcaaatggccttttacttttcagtgttttgttgccaacccccacccaaccattaaaaagtggctgttgtgaccagggagcacacacacagacaaagacggaaagtatagctttctatggtaaggaggaggctggtctggaaatgaggggtagagtttacttagaagcaggtaagaaaaccgggcatggtggctcatgcctgtaatcccagcactttgggaggctgaggcgggttgatcacctgaggtcaggagtttgagaccagcctggccaacatggagaaaccccgtctctactaaaaatacaaaaattagccaggtgttggtggcgggcgcctgtaatcccagctactcaggaggctgaggcaggagaatcacttgaacctgggaggcagaggttgcagtaagctaagatcgtgccgttgcactccagcctgggcaacaagagtgaaactccatctcaaaaaaagcaggtaagagttcacaagaaaaacaggtaatgctcagagactgtgggaatcaggaagaggtgtagggaaatcacagataatttattgcatctgtatattcctttataaataacatcacaaatgagaacaatgagccaggctgaagaatttgacaaaagagatagcaggtgtctctggagtttcccagtaggagagaaatgacttaagaagctatctgtggctggtgtttggtagacacttgacacaaatagcctgtgcctcctgaggagagcaggaaaggcagtggtggtcttcactgtgttgtggccaggagcacatgggtgtccagagaagggtaagaaaggaaattgctgaaagccaaataccaaagcccagattatgaggttttggaggttcccaccactgaagctgcactctgaaaactgggcagtttacaaaattagaggaatcaacccattccaacttcaaaggagaccagttacctccatcctggacacaggaagccagctaaaccagcctctttctgaatgcagctcagcccagagccacttgtaattgatgtttagagaaatactagaagcagcaggatggtaaacatggaatggctgccctatgctacgtggaatggtagattgctttactgttcacctagtgataacaggagtagtcacttcattttattgatgataaattgaggtttagccaagtcacacagtgaagtgcaagagctaggattacaactgagttctgtctggcccagaaccagctctgcagtgtcccatccaccctcacaccgctgctcctctggacctctgtcacacaggagcagacaaggatcattctgggatgcagcagctactgcccacagaaaagccatctccccgtggccttgatactcccttttaagaagtggtaaactggccgggtgcaatggctcatgcctgtaatcccaaaactttgggagtcccaggcgggcggatcacctgaggtcgggagttcaagaccagcctgaccaacatggagaaaccccatctctactaaaaatacaaaactagccaggcgcggtggtgcatgcctgtaatcccagctactcgggaggttgaggcaggagaatcgcttgaacctgggaggcagatgttgtggtgagccgagatcaagccattgcactccagcctgggcaacaagagcaaaactccgtctc

SEQ ID NO: 143 - DNA, 2118 bp, Homo sapiens
agctcgcggtgtccccgagcgccggcggccgggaggatggcctgggctgcgggtggggcgcgcgcccgacggctggggctcccctctgagcggctgcggctcctgcacctccccggggagccgccccgtcgatgccactaaggccaaggacatatagacggtctgccctcccccactcaaaccgggatcatgacggtccccaaggagatgcccgagaagtgggcccgggcccaggcgcctccctcttggagccgaaagaagccctcttgggggacagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagccccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtcctgagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatgttgggtctgaggggcctagaagaaagggtccatcctggccaggcacggtggctcatgcctatagtcatagcactttgggaggctgaggtgggaggattgctcgagcccaggaatgcgagaccagcctgggcaacatagtgagaccacatccctacaaaaaatttaaaaattagccaggtatggtggcatgcacctgtggtctcagctggccagtgactcaggaggctgagatgggaggatcacttgagcctgggaggtcaaggctgcagtgagccatgatcttccactgcactccagcctgggcgacagaatgaggccctgtctctcgagaaaaatccacacacaaagaagaggtccattctgtgtcccatgtcaagaagcagatcctggctgggcgcagtggatcacctgaggtcaagtgttcgagaccagcttggccaacatggtgaaactccgtctctactaaaaatacaaaaaatagctgggcgtggtggcaggtgcctgttttcccagctactcggggggctgaggcaggagaattgcttgaatccaggaggtggaggttacagtgagccgagtttgcgccattgtactccagcctgggcgacaagagtgaaagtct

SEQ ID NO: 144 - DNA, 1745 bp, Homo sapiens
aataaggggtcataggtggaaaagacatggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgatgaagattttttccccttggtttgagtcttttttttccctcctcctatttgttattgttgccctaagattgtcagtgacaataaattttgacaggttgtctaatcaagttggttatgtctcatgtgaggttgtaaggtggtttttcttgttttggtttggtttggttttttaatagctcctattttggtggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacatgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcctgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatc

SEQ ID NO: 145 - DNA, 2167 bp, Homo sapiens
agccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccagcccctgtcgttccaggccaagctgaccttcgaggatgtggctgtgctcctctcccaggatgaatgggaccgcctgtgccctgctcagaggggcctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgctctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtgggcacgccttcagtgcacgccggtctctgatccagcatgagagaatccacacaggtgaaaagcccttccagtgcacagaatgtggcaaagccttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcgcttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaac

SEQ ID NO: 146 - DNA, 2954 bp, Homo sapiens
ttccaatctccactggataaaacttgctctccagggcctgctattgtgctgaacacaatcacagctcctggagaggtttttctgtatttatttgtgctgtcccctgctgctcactcttaactcagcccttcccatcagataaaaagaaaaaagttggcttaggaaacctccccttcagagcagaggctgttcctgctttgcccctagcatatgttagccataggccctcccagagtatcccgaaggggctggaggcagggcagagcctcaggggtttctagccccagatctagccgggttgagacccccaggtgtctgagtccaggcactaagaagagaggggtctgatggcagcagcagcgaacattctttgcaggcctccaagtgccaggtgctgggctaaatactctacgtagattattttgtttaatctgagaagggcaaacccaaggctgggcgagctccactgacaagtgggtaggattctagccccctcccatcaagtccaaatgccaccttcctcctaaggcaattacagctctctggggtctccacaaggccttctaaggatgtcaaaaggattgcctacaaagacaaataccaggctttctcagcaaggtggagcctggccatgaataacattttgttctaagctggacggatgctggcacagaaagaataggttctttcgttcctgctattgtcttaaaacatatgcttcttaatgaaaagttagaaaatgttgatgccagttacattcccatcagataagagcgagggtcagctggcttctcctgttgaaaaaaacaattattacgcccctcctttacataaaaacaaggtgcttcatacaactcaagagtaaattgctcggatttattaaccattttttcaatcaaatggcttccacttgcacagacgtgatctatgatcctcacgagccacctgggtgaatgttgctcccttcgatacacagatgagagcctgcctggcttgtcgaagctcaaagggagacttggggaaggagctaagatctggacccaagtctaaccccaaagctcaggcttcagtccacaaagaggctttgattgggtagatctgggttaggagctgggaagttgaatcttacaacaaaatataaaagcctccagataattctgatgatcaaccaagtttgggaacccttccccacatcccaggatctcaggtcagtggcagagctggtctgtgatgaaccaagcatcccttgccaggatttgttatcactgtcgccctaattcacaagaccacagtcagacaaggcctgggaaacctgccctcgctgagacctccatgggaaatcacccacatcttccttcagctcggcaaggctcggaatgcccccgggacatcccactgcagtctgctcaagtgtcaccttatttgcaaggagattatctcttgtaaaatacaaaagtatgagatgagagaatcagttaggtgcacagtttcttaaaggaaaagcaatccaccagtatcctattctccctttctcccctcacaatcttgagaaacctctgaacattgaaaaaaatggcctagaaatgttattattgtaccaacttatttccttttcaatgtactctcgttctcttcgttctattgttaggaaggtgagtataataaatgctggtcttaagttttctgtggagacagtcacttcagggaaacttagtgactgtcctcagggcctggctggagggagattaagagcaagcaagccagaagttgtgattacaaactcttcttttacagaaaggtggctgtttttagttttgagcctttatatcagtgcatatgtagtgggtcgaaatagtgtctcccaaaagatgtctacctggaacctcggaatgtgactttatttggaataagggtctttgcagatgtaactctaccaaaagacacatgcactcaagtgtgctattcactgtgctattcacaatagcaaagacagggaatcaacccatgtgcccagcaatggtagattggatcaggaaaatgtggtccatatacaacatagaatactatgcagccataaaaaaagaatgaagtcatgtggtttgcagcaacatggatggagctggaggccagaatcctaagcaaattaacacaggaacagaaaaccaaatacggcatgttctcacttccaagtggaaagtaaacatcgagcacacagggacataagtatgtggactattagaaggttggggaggtgggttaaaaaactacctatggggtactacactcaccacctgggtgacgggatccatactgcaaaccttaacaccacacaatattcccatgtaacaaatctgcacatgtgcccctgtatctaacataaaagttgaaaaaaaaaaaagaatcaagatgaaatcttaactaggagattaggtaggaggaataagttcaagagatctcttgtacaacatggggattgtattgataacaatatattatatacttgaaaatcagtaagacagtaaattttaagttctctcaccacaaaaagtggtatgtgaggtaaagcacatatcaattagcttgatttagccattccacaatggacacgtttcaaaacatcacgttgtattccataaatatatgcaagtattatttgtcaattcaaaaattaattttttaaaacactgcctaaattaggctgttcctttgaagtatgaagtaagtttgattattaatcactagaaagagactatatttgctttaaaattaaaatagaaatcttgacatctcatttctattttctgtaattggttatttttaagcaatacaaaatgccaagttcataaagtttattgtaatgagtctgttctggctcccagaagatgcctcagttcaaaccgctaagctttacgctcaccatttctcaatctttgtaattaaaacaacaacacagt

SEQ ID NO: 147 - DNA, 1998 bp, Homo sapiens
acttccgctcgagcgcgcctcgcgcggccgcggcgcgagccgggacccctggaagggtcgggtgcgcggcccaggaggtaccgctgtctcctcacaatcggccaggcctgcagccgctgccgccgccgccgccgccgccgccctactcagggagtggcccaggcctgcggcgcgccaccctcacctccttcattcctaccgtcaaagcccagccttggctacctgacccccctgtggtctcgaactcggttagtccggtgaagggacagagaagcctgggttcccggcggcatcactgagatgctcagtcctgaattctgccctccattaggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggtgggagcacagcatggccgtgggaacgagtgctctcagcaaggagccgtggtggaccctgcccgaaaactttcattctccaatggtgttccacatggaagaggaccaggaggagctcatcttcggacttgatgacacgtaccttcgctgcattgagctgcacagccacacccttattcagctggaggtgtttcacagctacaggccagacacgtgtgactgtagtcggaccaccaatggcaaagcagtggctgctgctcatgttccattgcgtggggagccaggactccaagtgtcacgctcgaggtctgaagatgctagagcgtgtccgaagccagcccctgaccaatgatgacctggtcacctccgttagcctgccaccgtacaccggagactgatctcccctgggaagaggggatgagaggagaagtcttggcttcgcttttgatggagtcttactctgtcgcccaggctggagtacaatggtgcgaactcagccacctgctacctctgccttctgggttcaagcaattctctgcctcagcctcctgagtaactggaattgcaggtcagagcagagcatggccatgggaacaagtgccctcagcaagaagccgtggtagaccctgcctgaaaactttcatgatccaatggtgtttcacatggaagaggaccaggaggagctcatctttggtgagtggcctttgcccacatcccctccttcatccttgtcttctccattttcaatttttcccttctttcctaccttcatcagtcacacatcggttcccccaaggctacctccccactccccaagggctggtgcttgatagaccctcctctcgcctcttatgctcacagggcatggtgacacataccttcactgcattgaggtgcacagcccctgaccaaccatgatctggtcgcctccattagtgtgccaccgtacaccagagacctgtctttggcctccaggataagtggaaccgtctgtcttagcgtacctcagcctttcccttaccaagtgattggtcgttaggtattctatttgagttcactctattcgtaattaaggacagatctcccctgggaagtggggatgagaggagaagtcttggcttcacttttggtgagaaagacatgaaagacactgaagaaagtttgaacttgtggcggggacctgtccctctcaggccttctaggcacgtgcctgagggaagtctcctgagtgtaagaagtgttattggcaaagcaatccaataaaataagctacctgtgatgc

SEQ ID NO: 148 - DNA, 2686 bp, Homo sapiens
gtgagcaggagacagggagggctgaaggctgtgcagcaccctggtatggggtgagtgagggtgcctagagggcgcccacagaaggggctcctgactcggactgaggggcagggaggtctccttggatgaaggggtgcctgggctagggctgcaggctggctggcccttgccaagagaggacaagagggagccattccgtgtagagggcatagtggctgcaaaggcctcagggagctgagggcatgtggcgtgctctgggtagcacatgactgagtgtgcgcctggactgggcatccgggatggggtcaccaagagcctcgtggacgatggagaagttgcaaggggatttgctgatgggcagccctgcccagcagcgactccactgggcttgttccttgtccgttccttgaacaacttgaagtcacagcagccagaggaaattctgccaccattttcccaggtctgcagcccctccagctgggaacctgctcctggagccatccctctgcaaacagagagcccagagtgcctcggggaaaattggctgaataaaaggtataaagactttctctatttttcctgaatagtttttgacagatatgagcatgttgaacttcttgggagctgctgataatgaaagccaggagtttctggggtttcccagccactggagggaggaagagtttgggggctgtggagggaaggcttggcgccgtttagcacctctgtgtcgtgctctctcttgtcccccatggatgagcccaaaatgtgctgggaaaggcaggactgggagccggaggggctgaaagggaaatggataaatggggtaaggatggaggacgattgtttttaggcaattctggctggcctgagaagcaatgtcactgccttcctgatcctttccctcccccaaccccaaggtcccccaccccaggtgctccgcgcatggccacccattcctcaggcagccccagcttgctggtccagggtggtccaactcatctccatggcctggtctcctcggggaaggggcttcggataccagctcagttcccagtgttgaccctcgctgggggactggctactactgcctgagcccattggtccattgctctgtacctccaacccccattacccacctgtggctgaccccctccacagattcacttgcagagtttactttggggagattattatacaagtatgatgcttctggaccttcaatggggttgtgtcccgataaacccatcataaggtgaaaatattgtaagtcaaaaataaatttaatggaccgggcttggtggctcatgcttgtaatctcaacattttgggaggccaaggtgggcagatcacctgaggtcaggagttcaagaccagcctggccaacatggcgaaaccctatctctactaaaaaatacaaaaattagccgggcatggtggcgggtgcctgtagtcccagctactggtaggctgaggcaggagaatcacttgaacccgggaggcggaggttgcatgagctgagatcacaccactgcactccagcctggtcaacagagcaagactccatctcaaaaaaaaaaaaaaaaaaaaagcacttaatgcccccaataaacccaacaaacataaagttgaaaaattcaaagtcaatcgtaagtcaaaccttcgtaagttggagatcatctgtaatgtatatttagtgtgaacaaaattagaaaatgcagccatcggccctcaggtggcctctcttcgctaggtcctgggttctgggtggtgtgtgcacaaggccagcgctgcgtttttcaaaaatcaggaccggaaactagatccgtcagcgtatgaagtcttcttcagccaaaactagaaaagttgggcactcttttttgtaccgcgtttgccctaagcccgcccttggctcagaagtgggcactgaccagatggcctggagctagacctgacattagaactagacctgggctagacctgagccgggtgcttccgtcctagaagcaggtcacctcggagccactcagggctgcgggcagaggcagctcgggctctgctgccggctctccggctttctagcaggaagaggacaaagagacagagcccagggggtccccttcacatggcctcaggcttcccacagtgggccgtgtgtaacagggtcccccgtaccgagtggctgcctgtgtgtgtcagggttagatgcagttttccgtgggagtagacaggaaggccgccgggtgttggcctcacagacgcccgcaagtgttcaccacgaggagggcagcagccgtcacagccgcctcctgagatgccaccgctgtaaactgaatctattttacagggaagcatcggaaggagcccccaggtgagtcacttgtagaataaagaattcatttgccgggccgggcgcggtggctcacgcctgtaatcccagcactttgggaggccaaggcgggcgtatcacctgaggtcaggagttcaagaccagcctggccaatgtagtgaaaccccgtctctactaaaaatacaaaaattagccgggcatggtgacaggcacctataatcccagctacatgggaggctgaggcacgagaatcacttgaacccgggaggcagaggttgcagtgagccgagattgcaccacttactccagcctgggcaacagagcaaaactccgtct

SEQ ID NO: 149 - DNA, 2436 bp, Homo sapiens
ctctactggatattttttaccagcatccaaatttccctcctcttaaatatcctctcttgacccgtctcttcctcctctgccccattttatttcttccattttataactaaaaaattacttcagtcatctatacttgtctccagttcctcttgtctcattgttcttgtacccactcaataaggcttttgtcccctcacactgcagaagctgttcacatagaggtcaccagtgacttccacattcccaaagcctgtgggctggtccttatcttcctcatcctacctacagctttgtaggagagctggtctctcccaactccttaaccactttcttgacttggcttgagaaaaaccacatttctctcattttttccttgttcatcactcctcagtctccattattccttaaccacctagggtcatgtcattggacctttccttttttttttttttttcctatctacgctcactcccctattgatcccattgaatttcatagctttaacactgtgtatatgctgacaattcctaaatttatatatctagccaggacctcgcctcttcatgacagaataactttcaactgcctgtttcctatctccactatgatgtctaaaatgtgtcaaacttaacatgtccaagctaaaggtcctgtctttctcttcctcatctccccaacactgattcatgttttagttgataacaactcaatttgctcaacctaaaacctcggagtcatcctagacttctcttttctcagcatgatagccagaatgattctgctgtaatgtaagtcaaattatatcacttcctatacaaaaaccttccagcagcttctcttaaaaatctgttatcctaatggcctacgtggtctcattcccagttatctctcttaccttgtcttctcctactttccctttcattcactttattccagccacaccaatttcctttctcacccttaaacacaccaggatgctcttatttcaaggctattctttccacccagaatattgtaacttcaccctcatctccctaggtgtttacttaaatgtttttcactcagtctggccatcccttttaaaaattacagccccaactgtgaagacttcatgctctgttttctccaaaacgtgtattaccatctgctataccatacaagaaatgtgtcatctgttgcccccagttgagtaggactagggtttttgtttgttttgttaagtattgtatccctgactcctaaagcagtacctggcatatatagtagaatgattgaatgaatgaatgaatatcagaaatttggttaacaacacttatcttaaggagcctgagacttctggagttgagggtcctggaagacagtgatagaaagattgagtttcctttccctttgatttgccccattttcataaatattgaaatcactttcttgatcatgcaatttgatgttactattgatccatcattaattttgaactgtttggctttgggttacaaatatttgttaaaatttggtacagattttctttgttattcaaacttttgcagttcctctgttgagataatacaaatttggatatcaaaggatattgtgttatctgaatctacttggttccttagttttagatactgggaagtaagatttgggttaccaagggacttatctgaaaatttaatctgttcaattcctgggtctggatatcaagaatttggatagcgagggatatctgtaatcatactttaaaattttagttatcttagcatcagttttctgaaaattcactagaaaattataacaacccttaggtggcagcaaatcagtgaaaaacatctgaatccagtgcttaacatctgcgtgtcatactcctcaccatcagggtgttaaatttagaaagacagatatccagaggcacagtatgtgaggaagttagtattactctccagctctgttagctgagtgagtaatggggctcccgctgtggagaaaggtgcaagcgtacccagggacatggggagaaattaaagttaaagggagtctgggaagtagtgacagtgaggagaagcactcagaaattaagtactctaattgcctcctcaggaattccgtcagaaatcgctggactgggagaagcaacgcttgatttatcagcaacaggtatcttcactggaggcacaaaggaaggctctggctgaacaatcagagataattcagagatggggttttaccatgttgtccagtctggttttgaacttcgggattcaagcaatccgccagcctcagcgtcccaaagtgctggaattacaagtgtgagctaccaccactggcagttaagaattttaacaatttgtcaatgaaacaagaatctcaattagagtctttatatacaatctgtactgttggaattttcaaataaatattgtaaagaaaattaacact

SEQ ID NO: 150 - DNA, 2857 bp, Homo sapiens
ctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcacccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaaccactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaac

SEQ ID NO: 151 - DNA, 2720 bp, Homo sapiens
gtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagagatttacagattcattgttagagcctctgactggggttcaccataccgccatgaaagtgaggtcaatgtgactattcaaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaattttgccctcagaattacagcaactgatggagagaatcttgcagaccccatgtctattaacatttcagtcctacatgggaaagtgtcttcaaagagcttcagttgcagagaaactcgtgtggctcaaaagctggcagagaaactactcattaaggcaaaagcaaatgggaaactgaatctggaagatggatttcttgacttttattcaattaatagacagggaccatattttgacaagtcttttccttctgatgtggctgtaaaggaggatctgccagttggtgctaacattctgaagattaaagcctatgatgccgactctggcttcaatggaaaagtgctatttacaatatcagatggaaatacggatagttgctttaatattgatatggagactgggcagcttaaagtccttatgcccatggatcgagaacacacagacctctatctccttaatatcaccatctatgacttaggtaatccacagaaatcgtcatggagactgctgaccatcaatgtggaggatgctaatgacaatagccctgtttttattcaagacagttactcagttaacattcttgaaagttcaggcattggtactgaaatcattcaagtggaagccagagacaaagacttaggttctaatggtgaagtgacttactcagtcttgacagatacacagcagtttgccatcaatagctcaactggaatcgtttatgtagccgaccagttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggtaagtgtaatattttgtgccaagagtgttgtttcacctcttttaaatggtcaacagtggaaaagtaaagggatgttaggacactaaaatagaatgacaaatgaggttgcatttggtgcagagacgacgcacatagatgctttttcttaggatgttctggtttgttagaagatctgtttataaactaacagctgtggtttccagtgggagtcctggtttgttttgttttgttattttcttgctcagcactattgctaccaggtcatcttttgataagcctaagtaattgtcacttctgttgattgtacccctgaccctctctaaatgaaggactctgataaagtaaattacatttgaattggctttaagttagaagtgtgaaatggattttcaaatgggtcttatataggaatctttccctttacagtaaggctttgcagaagtgatattgcattagttgcttggtcttttatctttcatgggttcatctggtccttgaatgatgggcatttgcactctgtagctccattaatataaggaggtgtgcttctacaaatgttttcttaatggaataaatgagtcttgctatgaattttatttataaaaattgattttaagaatttatttgtaaggagatatttacaaaacattaaaaaatatggggcaacattgttccagt

SEQ ID NO: 152 - DNA, 2845 bp, Homo sapiens
acacacttttttctcctgcctttggacatcggaactccaggctctccaggctttccagactctggacttaacagcagtctctggacttacaacagcagccccctggatcctcaagcctttggcctcagactaataattatatcagcaacttcctggttctgaggcttttgggcagccatgctactagcaacccagcagttccagcagaaggcctgttgtgggacttctcagcctccatgagcatgtaagcttgcttaaaagaactccagatggcccgggagctgcaggaccctttgccaattatcagaggaagataaggcctgtgtgaaaccgggacaaacctgaaccagcgaccccgtgttacctttagatcattaacatatcatcataatgctaaaacctcacccatagaagataattgctgccattttctgaatatacattatatgaagaagcatgttcatgatctgcacctgcacatctggagttcctccccatacatgtttacgtacctccctgccccacatctaactccttaaaatcccccagcttctcatatctcagggagaaggagtcttcagagaaagagctccctcctccattcctggccaggaataaaacctgcttgccttttttcccaattaggtgttacagtagaactcagttaccctgtaacaataagaattgcattaaatccttatatcaacttgggaagaattgacagctttaccatattaagtcttctaatccataaataagtatgttcatccatttttttagatttttgaaatttctttcatcagcattttgtagttctttgcctcactatctagatcccaaatattttctgttttttttttctgaaagttttatctcttacaatttacacctgagtagttctcagcatgcaagccccatacatgttttgttggatttaaatttaagtactttggtttttgataaattgtaagtgctactgtattttaagtttcagtgcccatgtgttccttgctggtataaagaaatacaacatattcctgcagtctagctgaagtcacttatcagctctaggagtttctgttttttgttttatttttggtagatctttgagatttcctactttgataagcatgttatccacgaatagggacagttttattactacctttctgatctgtatgccttttatttccttttcttaccttattgcattgggtagaacttctaacactgtttaacaataatggtaagagcagtcatccttgcccttttcctcttctcaggggtacaaccattcagtctttcactgttaagtatgatgctggctgtggagttgttatagatgctctttaacaagttaggacaaattccctctatttctctttttctgagcatttttaaaaccatgaatgggtattttgtgaaatgctttttctgtattgattggtaagatcaattttcttttgtatccagttagtatgttggattatgttgactgatttgtgaatagtaaaactgccctgcattcctgcagtaagcttcgctgtgttacaagatctttggggtgttgcttttctggccagaaacctctgtggccagtggtgcctttgcccaagttttgtttgggctcactgggctcattccgcccactcggcctggcaggctgtgctcagctcatgctaccagcctggaccccatgtctgccaaaggcaagtcaggcatggagtggcaaggggtgtgtgagtgagcgtggggtctggccactgtgcagtcagacatgtcagctgctgcagtggggtgggcagctccaggtgctggcacaggcactagtcctctgtgaggctgtggctgagccaggcacactgcacgcagcttccacagctggtactggggaacaaagtggtgcctggaggcttggagatgccaggaaccacagggctcccaagaaagagtcatagccctggcttggggagctcccaggtctgggcttcccgaagggccatagctattctttctttctcttcaccctcaatgtagtgagcaaggggcatgtttcaaccctgtttgtgttacagctcttttagccctaccattcaatgggtcccaagttcttgtcctataaccaggaagaatgaggtacccagacaagtggagggtgagcaagatgaaaaggagctttactgagcgacagaacagtttggaggaaacccgcagtgggtagctcctttccacagccagggtgtcctgatgagtgttcagctcctagcaaagaggaggccctggagtgggaagctcctctttgcatgcaggtggtcacattgtctctgcagctctcagcagagaggaggccctggagtgggtagctcctctctgctgttggtcatcctaatgtctgctcagctctggttgagcgcaggggtattatgggcttcagaggggggaaagtgtatgccaactggtccatgggcaggcccagaaaaggcaccacaagctcccactctggtctgtggggctggcagcccgacgccagccttcaggccctccctggcctgaaggtggggcctcactggggacctgcccccttctgcccaggagcccatctgcctcctgccactgcacatggcacccaggctgctcacagcaaggggcacctacaggccagggcaagccgccctcaacttcgtcattgtgtatacttttttttacattgttgaattctacttgctaatttaaaaaaatgttgcatctatattcatgatattagtcttttgttttttgtactatctttttttttggtttgagtatcagatttagtactagcttcataaaataaatgggaaagtct

SEQ ID NO: 153 - DNA, 2357 bp, Homo sapiens
ctctgcgtgcgccggaggctgccgtggcgggtgggccccctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagagtaacaaacccccttggaggactctcctgccgggatgtccatgtccgcctttgctccgagctggggtctcatgtctgtggtgctggaatccagagccctgacgggacagcagcagcaggaactcgttacgctgcagcagggcccacacggacttggcttccgccagggacacccggttgtccttgttgaagtcagccatgagcaggacctggccaaccagcgccggcagggaaggcaggtctcccaggttcgcctggcgtttgggaccaaaagaaaggaaaagccagctgatttgatgtctgggagcacgacctggcctttacctggtcctcctggcggggtggtctgccggccagaccagcacatctgccaggttaggggtcccagcccacagctacacgggtggaggacgcagccagcaatgtgtcagctcactctgctggcctgtgtggctgctgccagacagacctcccgcctcctggcagccttgggtgcacctggggagctcgggggtgggcacctgggcagagaagcctcagagcttccctgaggatgagaatcggcacagggcggagggcacgcactggctgaagccctgggaagcggcccctttccacaagccctggtctccattcggggcacctgccctgctggacacacggcccttgactgcaggagcctcccctcgacctcagctgccagcccaccggcgcccccaacccttgcccccagccctggagaggctccttccctggcagggctcatgcccaggggctgggggatgggaggtctgcccagggtccacttgggcccatctgtgcctttgtgctgggcatgttggtgccagggccgcctgctgggcatatgaccgtggtgtggactcctgccctgccccctaggagagctgcctgaccttgaggaagccgagggtcatctcccggaattccttgatggaggtgccccgggtgggcttgtcaaacagtaccagctcccgccggggggccgcatccgaccgggccttggagtcgagggtctcctcaatgccacacttgatggttacatccttgtcccgccagagcccgctgtacacctggacagggccacagaggtcctccgtgcagacatccccctcccactgcacgggcagtatcagccccaggcccacccgccctgccagtggctatacctgctggcccggggccaccgagaggcaggtcctccactccaccatatgcagctcacacaggtcctggcagacggagcccgagatgatccccttgcggtactggtcacactgaggagacaggtgcaggcgtgccgggcggggcagccacacccctgccccactgagcccctgcccacaggcccgaagctggcaggggcctccacttgctgcagttggaaagctgccagcccctcacacaggcagtgccggggccctgggtcatgccattggtggctgcaggatggggctgtcggctgcaggggcagccccgccaaccctccggtccggtcccgtccccaccatcctggctcctgtaacaggacggcacagcaaaggccactgcctggacatgagacacacaccacacccagtgtcgaccccacgccagggccagaggcaggaacctggaggcagctctccgcccagccgacccagctctggaccatccaggcattggtcggtgaactagaattcacactagtccctaatatctacaccaccagctgccacacgcgcgctctctgcctgactcttcattcctgcctcgggtgacgccaggagggaggatgcaccccctgactcatggcgccctccctgcccggaatagtaagtgagacatttctg

SEQ ID NO: 154 - DNA, 2782 bp, Homo sapiens
tatttagcagacatctctttcgctgctgttatgtgccaggtactgggctgctgggggatcccaagtgagcagagtctgttttctaccctcgaggagcccagagataaggaaatagataattactgtgtgatgagactccagacagaggtgggtggcatgttacagggatacctgacacagctgagtgggtggcatggggtcagggtgggtgactcccggggctcttcaagctggggcctgcggggtaatggaggagtaggccggggaagtggggcctgtgcttctggcgacctaacatcctgggcagagcttgtcaaggtcacggaaggtggcatgctgggcaaactggaagaacatcagccctgctgagacctgggcaaggctaatgagcacagatctgtttccaggctaggagtgggttctgggcgcctaataggttcccagtaaacatctgtcgaatgactgcggtggacggggacaggggaggaagcagtcgggagacgtgccggtgccacttccatccccccctggaggcccttgtgcttctgctccaggattggcaaccaggaggtgggataggacccctgttgtaaacttctggatcttggaaaatcaaggttaggggtcagtccgatggcctctggtcttggaggggaggggaggggagtggggagaccttctgtccacacagcagggacatctctcctggccctgagggcagctttagccagagcctgttgccaccccatgggattttctactccctttttgagactaagaaagacggaactgagactgttgatttttagacacaaggaaggcttgtgttcttcccagaaagaaagggttatggggccctggaagatgcccaggatgcagccaaggcccaggggtgctgagtgctgggtgggccacaagtcacatcctctcatctttgacaaataccacccggatagcacctacgcagcaaagcgctgtggtgaggggcaggctctatattaggagtcatagctttgtttttggttgtgggaactcactgggtcttctctagctgcagatttgccttcaacaaacgagggattctaatacctaccccagggttgctgggagggcccccacggtacctgtgaccgctggggagtgccaagcaggctggccccaggactcactgttccctcctactctttgcaggggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctgactgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgcttctttctgggcctggctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgagtcgggcagaggcctcctttcaaggagttcacagtgaacaagatgagaagggctgggccctggagggtcaagagccccaattatgtacaagacactttgggaggaaagaagactaccttttccccctgccattggtatagctggtgccccaaaacttccacctccctccctggccacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccgctacttgcaccaaccagtcccgggttagatcccaaatgctagaagccagggaagcccaactctgggtggccccagtcagaacctctgggatctcagtgaagctggcctggcctctgctcctgctctcaaggggctgcttttcaaccaagagccttgtgagcctggtctgagccttgcacagccactgagtattttttttgccttagccagtgtacctcctacctcagtctatgtgagaggaagagaatgtgtgtgcctgtgggtctctacaagtgacagatgtgttgttttcaacagtattattaggttatgaataaagcctcatgaaatcctc

SEQ ID NO: 155 - DNA, 1575 bp, Homo sapiens
aatttctaggtgtgagccctggtgtgggcgtttttataaagctcttcaggtgattcttacgtggaaccaactttgagaaccactgatttaggtaaactcccttatttggcatttaagttaactcaaagccaatgagttaaatgacgtgctcaaggtcgcaaagttggttagggtaagactgggaagtagaatgtagctcatgtgccttagtttagtggctgtctggggtgaatggaatgagctggagcttgaacaaattggaaacacatatgcttctcccaaactctggaggcaagagagagagatgaaactttatcagtgtcccttccataagtagcactagggagttccagaagagaggcaaccttatttcattctactgacttttttttttcttttattttgagacagagtcttggtctgttacccaggctggagtgcagtggcatgatctggtctcactgcaacctctacctcccaggttcaaacgattctcttgcctcagtctcctgagtagctgagactacaggcacgcaccaccatgcctgcccaatttttttttttttttttgtattttttgtggagatggggtttcgtcatgttggccaggctagtcttgaactcctgacctcaggttatcctcccgcctcggcctctcaaagtgctgggattacaggcatgagccaccgcgccctgcccctactgactttccatgttgcatttatgcagggagaaggttcctatcttcatatctgactcagggactctcccctcacccccaccttttccttttcctcttagacttcttggaggtttttcaggagatattctgtcggctctttggagaaggcagtggctgggggttagggatgatacagttgaaggataggtagctaccaccactcagaccttttgcaaagctctaagcaactcgattgttttgtaggaagtgtattggggacagaaagttgtgtaaagcttgaaggtgggataaaatggttcctgatagatcaaagagggtctgtgtatttcatgtatggtttaacataagttatataaggtatgggaacccaaaggattataaatcattctactataaagacacatgcacatgtatgtttattgcagcactatttacaatagcaaagacttggaaccaatccaaatgcccatcaatgatagactggataaagaaaatgtggcacatatacaccatggaatacaatgcagccataaaaaagaatgtgttcatgtcctttgtgggggacatagatgaagctggaaaccatcatcctcagcaaactaacacaggaacggaaaaccaaacaccatgtgttctcactcgtaagtgggagttgaacaatgagaacacatggacacacagaggggaacatcacacaccagggactttcgggagtgaggggcaaggggagggagagcattaggacaaataactaatgcatacggggcttaaaacctagatgacgggttgataggtgcagcaaaccaccatggtgcatgtgtacctgtgtaacaaacctgcatgttctgcacatggatcccagaacttaaagt

SEQ ID NO: 156 - DNA, 2608 bp, Homo sapiens
aaactggaagcattccctttgaaaactggcacatgacaaggatgccctctctcaccactcctgtattggaagttctggccagggcaatcaggcaaaagaaagaaataaagggtattcaaataggaagagaggaagccaaattgtttctgtttgcagatgacatgattgtatatttagaaaatcccatcatctcaacccaaaatctccttaagctgataagcaacttcagcaaagtctcgggatacaaaatcaatgtgcaaaactcccaagcattcctatacaccaataatagacaaacagctaaatcatgagtgaactcctcttcacaattgctacaaagagaataaaatacctaggaatacaactatcaagtgatgtgaaagacctcttcaaggagagctataaaccactgctcaaagaaataagagatgacacaaacaaatagaaaaacattccatactcatagataggaagaatcaatatgatgaaaatggccatactgcccaaagcaatttatagattcagtgctatccccatcaagctaccattgactttcttcacagaattagaaaaaactactttaaatttcgtatggaaccaaaaaagagcccatatagccaagacaatcctaagcaaaaagaacaaagctggagacatcatgctacctgacttcgaactacactacaagcctacagtaaccaaaacagcatgattctggtaccaaaacagagatatagaccaatggaacagaatagaggcctcagaaataacccaacacatctacaaccatctaatctttgacaaacctgacaaaaacaagcaatggggaaaggattccctatttaataaatggtgttgggaaaatggctagccatatgcagaaaactgaaactggaccccttccttacaccttatacaaaaattaactcaagatggattaaagacttaaacgtaagacctaaaaccataaaaacgctagaagaaaacctagacaataccattcaggacagaggcatgggcaaagatttcatgactaaaacaccaaaagcaatggcaacaaaagccaaaattgacaagtgggatctaattaaactaaagagctttggcacagcaaaagacactatcagcagagtgaacaggcaacctataaaatgggaggaaatgtttgcaatctatccatctgacaaagggctaatatccagaatgtacaaggaacttaaacttacaagaaaaaaacaaccccatcaaaaagtgggcgaagtatataaacagacacgtctcaaaaaacagacactgtcttcaaaagatgacattattgcggccaacaaacacatgaaaaaaagctcatcatcactagtcattagagaaatgcaaattaaaaccacaacgagataccaccatctcatgccagttagaatggcgatcattaaaaagtcaggaaacaacaggtgctggagaggatgtggagaaataggaatgcttttacactattggtggagtgtaaattagttcaacctttgtgaagacagtgtggcgattcctcaaggatctagaaccagaaatactatttaacccagtaatcccattactggatatatgcccaaaggattataaatcattctacgataaagacacatgcacacatatgtttattgcagcactattcacaataagacttggaaccaacccaaatgcccatcagtgatagactggataaagaaaatgtggcacatatacaccatggaatactatgcagccataaaaaggatgagttcatgtcctttccagggacatggattaaactggaaaccatcattctcagcaaactaacacaggaacagaaaaccaaacaccgcatgtcctcactcataaatgggagttgaacaatgagaacacatggatacagggaggggaacatcacatactggggcctgccgggggatgaggggtaagaggaggcatagcattaggagaaatacctaatgtagatgacaggttgatgggtgcaacaaaccaccatggcacgtgtatacctatgtaaccaacctgcacgttctgcacatgtatctcaaaatttaaagtataattaaaaaaagaaaagacatgatccaatatagtaaagcatgaatacaggtgacaacatactcttcagtatcaataggcacatgcagacagtaaaataatcgctttaaaatgctgaaaggaaaaactgtcaatctagaattctgtatctggtaaaactatctttccagaataaaactgaaataaggacaaacaaaactaagataatttatcccaaacaaacctatattaaaagaaataatggtcgggcacagtggcttacgcctgtaatcccagcactttgggagactgaggagggcagatcacctgagctcagcatttcaagactgccctgggcaacatggtgaaacctcgtctctactaaaatacaaaacattagctgggtgtggtgatgcgcctgtagtcccagctactcgggaggctgaggcatgagaattgcttgagtccaggaggcagaagttgcagtgagccgagatcgcgccactgtactccagcctgggcaacagagtgaaactctgtttcaggg

SEQ ID NO: 157 - DNA, 2071 bp, Homo sapiens
atgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgacgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttgg

SEQ ID NO: 158 - DNA, 1892 bp, Homo sapiens
aatcgcgtcgccgccgcttccgccctcagccggccccacctctgccggctcgtactcggctcccccacctcgccgcagagctagcccgggaagcccacactggcggccacggagcagagtccctcacccccaccagctgtagctgaacgtctggatggtggagaagagcaggtgaggccgtgcagttggtcccctggcccgcctgccgcgccggccgggccaggcggagacacaccggatgcggggtgtgggggaggcgggtgtcctgggctgcagagatgctggggtggtgggaaaggggtgcgcgcccggggtggccgtagtcatccacgctcctggggtgcgcaggctgaggccgctgaagagtagaaggaaaagaaggaactggaatgttgggggaggtgggagggagagggtccgaaagattcccagagaggtcccagtccggttaagggttgggaacagcagagaacttctaggtagagttgtgtagtggggggagacagatacggaatctgtgtgattgaatatatttggggaggggaggcttagggcctagccctctttcctcttaagcccccagaagacctttcctggggaagggaaggttggtgttgggcctgtcacttggctgaaatatggagtccactccgcttctccagagtccctcagcagccctccatgtctcggggtctccacacagggaccagctgctgccccgggcttctagccagaattgcccatgccattctctcgattctttctttctctccagctgcttcatgtgagggcttgtcaggccgcgggttggaggccttagggccagaggcggtgggaccgggagaaccggtttggggcccgaacaggaccagagaactagcctgtacatccttcctccctggcacctctttcccatcccttctgctcacctcccaacagctctgagaccctcaagtcctagtatgatcttggtgggggcggggggtggctttcccggttccatatttcactcttgccatttggaactcagagaggtcgagttctgagcaccacttggctctcaggacgtggccttatgaggtctaatcctcatccctcctgttgttttctcagccccttccctattcactgtggggttggattcgggtggctcttccgcctgggctgaccagctcaggacttcatttttcctcaacccactctcttctggctgctttaaagaagagtggccgccagtggctcttacttccttttctggctttgttcccatcccccactgccctgcgctaccatcacattcaccctgacctgtcttcttcacactctgaccccaccctcaagtttcagagaccctaatgtcctagggaatggaatttcctggtcacttctcgtcatcattggtcatttcatgccaagtcccacacacacgctttccctccacccagctctggtcaggtccctggaaaagaaacagaaatggccttgttctctccactgcccctttccctctctccttctcctccccctctcttctcttccctcccagcactatccacctctgtccctcagctttgagcagagtgggggatgttgagggagagtccagtcacagtacagcctgcctgctggtgttgggggtttcctctaattcttcatttttccccaacccttaccacctgccaccaccaccatcaggacaaaccctatgactgactcactgacgtcccactgaccacagctcccctctctggacagcgtgttttagcttccgctccttctggttactcctcccttccagtggtgagaagagaagagaaagcccagcctcctgggttctcccctcccctagaagctacatttgagtgtttgtgtgatctcatctcaaggctgtt

SEQ ID NO: 159 - DNA, 1884 bp, Homo sapiens
cttcctcgtacctaatgccaaggtaggaataaacaagggcacctagtatgttttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcaggtgggctgggccccttccccagatctctgaagtcctgtgtcccttcctgcaggacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccggggtgtggggcggtgtggcgggcgcacactgtatgtacctataataaaccctttggctttg

SEQ ID NO: 160 - DNA, 2186 bp, Homo sapiens
gttcccacagctctcggtgagggcttcttgaaggtgccgccctttagcaagaccagggccttttctctggtccctgtctcttctggccatttgccttcccacgtctaggaagctacctcggtttctaggatttacatatgtttaacatgcgcattcgccctcctgccgagcactttgctgacagcacacacaatggtggggccttgaggcttgccacagacacacctggcaggcgcccgctcagccccacactctgctttgatgcccacagaaggagctcaacagctcgtgtgtgtttgaagggcacagagaacagatgccaagtcctcagcttttcttgtgcaacagcctgggctcgttgctgggctgtgtgcactgtggcctggctttcatgtctcattcacacctgggctgtgtaggtcttggcagaacttttgagagactctggtaactgttacactggaaccttttgggacttccaggaggctcttggacaagacttctcgtgctgcaggccgtgaatgtgcagccctctgcaaatgccacttataagggtctgagctttggctttgcacactttcaagggccttttatgaaatgttttctctcgttatttcagtgtttcttcctctaaacgagtatttcttattcctctctttttttgcgtcacagaattacctggcaaccagaggtctgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaaacacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 161 - DNA, 1825 bp, Homo sapiens
agctttcaccggctgggagtccggagctgcagcagaggccacacccagggcttggtggtcccgcgctttccggagctcagcaggcgcttgctgcttgaaccggtcaaagaaggaacgaatgaatgacccttttgccaggatggagacccgggggcctcagggagctgcgaatcccatggactcctcccgcagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgagaaaagcgaatttctggcaggcgtgtagccccgccgcgggacgcagcagacccacccaaatacgtgcttgtgcgggtggaggattatcaggtaacacaagaagtgttgcagacctcctgggccaagggtcgcatgaccacgaggactgaggagcacttcgtgaccgcgctcacttttcgcagcagtagagagggacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactttggcctggttgaagctctgtgaggagcaaagcagccctctccaggtgaactgcttgactttaccacctgaaggagtatttactgcaagaattaacaaagcagactgcagtgcaacggcacgatcttggctcaccacaacctctacctccagggttcaagcgatgctcctacctcagcctcctcagtagctgggattacaggcatgtgccatcaccccggctaattctgtatttttagtagagatggggtttctccatgttggccaggctggtcttgaactcccaacctcaggtgatcctcctgcctccgcctcccaaagtgctgggattacaggtgttcctgatccaagcagaaccctgttatttgaagagcctgagaaatcttatcccgtttacaaatgtcctgggagtgcatccaaagtgaaacttgggtatcctcaatactaagaaatctctgagaatgactgggtcttggctctttgatcttacctctactcctctgaaaaacatgattatctaaaattgtgttaggtggatgaaccgcatcaaagacttccagaagccactccagtgaccataagataaatgtcagaatcgcataacccccaggatcagagatggagtctcgctctgtcacccagcctggaatgtagtggcatcattgtaactcactgcagcctgaaactccttggcttaagtgattctcccacctcagcctcccaagtagctggaactataggcacaagctaccatgcctggctattcttttttgttaattttttttaaactaaggaatgaagaaaataaaacattacatgactggt

SEQ ID NO: 162 - DNA, 2433 bp, Homo sapiens
agataccggaggcctctgctgtggctgcccactggctgggcccaggccttgaagcggtggcgaacgtctcttccctgccctacctcggtgactgatggcggcggcggcctctcccagtccggaccctgccggccgtcgggtctcccggcccaagcctgccgggcctggacgaaacccccgccgagcagcctggacgcagcgcctttgggtggcggcgggagtagcgtgccgggaagcatggcggccgctcgaacgccgcgcggcggagggcgttagggcatggagggcccgggaaggcggcctagggacgcaggcaggctcggccgcctcttcaggccacggagccgccagatctgggtcccgggtgaccactctgtcgccattgggcgagacctacctagtcctaacgacaacggacaaaggccttaacgggcctgggaggtgagcgaagtcccgaacgacgacgggtggaacggttagcggcgatcgggcggttggtctccgtactaccagaccttgctgtcggaagagacaaatggtagaatgacaggccacgtttggcccgttggaaatgccctccatcctctgggaagattcactggccgtttacggaaggcctgtgtatataatatgaaaaagctgctctcaactccaccccaaccttttaatagaaaacatttgtcacatctagcccttctagatggaaagaggttgccgacgtatgatagagttagaaagtcacacatcttgtaaattctcatttgtttaaaagaaatcatagaaaatacatgtcttccggagttgacttttggaaactgagttgttagacggcctctagaagcgatacgttcacgtttgttcagtgggttagatgacatggagctcgaagacctgagaaggaaaaaaagaaggttctatgctagactggtcatatttagaagacattttcatattctatccattgttttgtgtgcattcgcttcctcactactatgtatgtagttgacaatgctaagcttttttgaaatgtctattctttttagatattctgaagtgtctgatatatgttaaaattagaggtagtaaaaccacattttgtaaatatctttttgttacaattcatagaaatgttgttttttggggggaatggccaaatcacctgttgagtaatactcattgtgtttgtgcagtagttcaggggaggagagaggagggggaggtgcagagagctctatgccatcctgcttacagcgaggcaagatgaatcactatgtctgtgcattttgttttatctatgtatataatgtacataaaggacaaacgagtcctaatttacaacatctagtctttctggatgttaaagaggttgccagtgtataacaaaactagagttagtaaactaatatattttgtacattttgttttacaagtcctaggaaagactgtcttctgaaaatttgagcattcttgcccactgggttgatggagatgggaagggttctaggccagaatgttcacatttggaagactctttcaaattataactgttgttacatgtttgcagtttattcgagactgctgtgtacatacatagtggacaaattaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattaacatattttgtatgctttgtgttgaaattcataggaaaacttgtcttctgtaattgacttttgcataggaatttgttcagccatctctaagcattacacatgcgtgtacttgtccactgaattgaaggcagagaaggaaaaaaagaaggttctatgctagactggtcatatttagaagacattttcatattctatccattgttttgtgtgcattcgcttcctcactactatgtatgtagttgacaatgctaagcttttttgaaatgtctattctttttagatattctgaagtgtctgatatatgttaaaattagaggtagtaaaaccacattttgtaaatatctttttgttacaattcatagaaatgttgttttttggggggaatggccaaatcacctgttgagtaatactcattgtgtttgtgcagtagttcaggggaggagagagg

SEQ ID NO: 163 - DNA, 1638 bp, Homo sapiens
gtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctcccccccccgactcaattacaagaataattgcttcaactctcaatgttcctttaactgggcacgttcagtgttagcatcttaggctctcatttcatatgaaagtactaagttgttccagtaagcagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggatacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcgggagttgaagatcagcctggccgaaatggtgaaacctcgtctctactaaaaatacaaaaattagccagtcacggtggccggcgcctgtggtcccagctgctcgggaggttgaggcgggagaatccacttgaacccaggaggcggaggttgcagtgagctgggatcgcggcactgcactccagcctgggcgacagagggagactgtct

SEQ ID NO: 164 - DNA, 2157 bp, Homo sapiens
gtctttggagaattgtctattgcagtccttttcccatttgtaaaccggattatcttgttttttttgttactgagtggtaagagttcctttatgttctggatattaactccttattagatatgtggtttgcagatatgttctacaattctgtatattgttccttcttactctgtcatttgcttcctatgttgtgcagagatattaaaatttgatgtaatgtatttgtctgattttgcctttgttgcctgtgcttttggtgtcatatcctagaagtcattgcaaaatccagtgttgggaagcttttcccctaagttttcctctaggagttttctagtttcaagcctatacatttaggtctttaatccaatgttagccctttcttaatgagttctttgtattttgggcagggaataagtctttctttaatgtaactgtcaggaatttactatatttaactttttccttcttccttcctcccctctttccctccctccttcccttcctcattcattccctccttccctctcttacggcttgaagataatggaatcactcaggttttgttcgtaactggtaaggttttagtttagtaggatgataattcattttcaacagcactttcttgtttgttcattggttagcaggaagaagatgagccttaggtctgaacgccgaggaattcatgtggatcctgtgcaagaaaggatgtggttactgtggcaaccctacctggcagggtttctgctccaagtgctggagggaagagtagcacaaagccaggcagaagcagattcaggagtactgggagctggtggaacgactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaagggctggagtgcaatggcgcgatctcggctcactgcaacctccacctattgggttcaagtgattctcctgcctcagcctcccaatagctgggattacagatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggaaaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtcctgcacttggcagggctttttcaaccaatgaataaggcaaattatatataagttaataatgccatttcgaaccgagacagatggcagctaaatgaagtttaattaaagaatgagcgctggggccctttttattgggtactgcatctacttcgaccacaaaagacgaagtgaccccaacttcaagaacaggctttgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaacggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatattt

SEQ ID NO: 165 - DNA, 1773 bp, Homo sapiens
agctcagcgcgcttatcctgggtccaccggcgctaccgccccccgacgtgagagagcgaagttcttgggccgcgctccctccctacctgggtgccctccccctccgggagcctgggtccccggggcggtcgcggcggctgcatcctcaggccaggccgcggggggagggggcggcacgggcctccgaaagcggggccatggagcccagagagtcggggaaggtaggactggaaggcccgggggccgcccgctccctcccgaggatccccgagccgggctcgggcgaggcggggcggctcgggcggaggccccgcagatgagccaggcttgcagggaaggactcgccggcccgccctctcttcccgcacttcggcgcccgaccccgggagggtggcggagaggagcggacgcttccgttcggtgtccgcgcatcctccccgagctgccgagcgtccgctgggtcgatgctgggttgggtgacccccgagtggagcgatgcgaaggtgcttcctgttttccccaccaccttcggcgttttgaagaggccctgctaaggcttggagtctggatcggacgccagtgggagctgcagggtgggacgcttgagggcttgaccctgcctagatcctccttaccaagaaagggctgaaaagagagggcatctggcatgctttttgccacttctgtttctaggttatgtacttcatggagtatctgggcattgcttagaaacctgtgtcataaattggctttgggcaagaggctttgagttggaagaaaaggtggaaagaaagtgcttgggggcggagttcagggatttgacgagattgccagcgcttccaggccgtgtcatccaagaccagtgtggttgtgggcacattagcttggagacagtggcagcctcttgggactaacatctttctggatgttgtttgctgccagttcttgagtattgtttcttatttggcacagaggagaattctctcaacaaacgttttcaactgtttattgagtcccttaaaaaactgtccatttaataaacatttgtgatctgtgatttgcattgaacgagatgctggaagtatgaggataaataggaaatgatcacctttctcaaggagctctcctgcagttttcacttcaataacttggacacgcctgaaagggttgtcccacacgaaaagagagaaaaggataatgaggttcttttgatgctgtagtttttcctgggaagactaggaaggactctgaatttcaaaagaggtgatttctcgcatgagcatctcttccatcctccctccctccacaagctacagtgatgcatgtagcagacacggcacctacagagtacatggtccaagccaataaagctcaacaaaacccaagcaaagatggagcttatggcccttaccctttggaaatatccccagattggtttagattgaacctgaatttgaataaagagaagcaaaatgtagggggaagaaggattataaaatattgggattgatattggtatcagtgatttgaagttgatttccaagctattctgttcagtcagaggctttcttagcctttaacgggagaagagaaatacggtcatgcgctgtataacaaggtttccatcaacaccgctctcacgtacaatcccctgagactacagtggggctgagaaattcctatcacctggtgacatcttcatgatcctgaccctgtgtaggcttaggctaatgtgtgtgtttgtgtcttaggttttaagaaagcttaaaaagt

SEQ ID NO: 166 - DNA, 2782 bp, Homo sapiens
tgtgcagccttctctcagatggcttcataaaactgaccacccggacaacaagatggtcacacagctattagtggaggttaagttcattctgccttcattatagttcatttttcttgtatatctctctctgactagactatgagctattgcagtgaaatggctgtgtccttcatcactgtcaccctccagtgacccgcagccaggaggtgtcagtgattgccatttgagttgaactatttattgacatccagtgttgttctgccaaaaatcctgatcctaggcgtggtggtttgcacctgtggtcacagctactcagaaggctgaggtgggaggagtacttgagcccgggagttcgaggttgcagtgaactatgattgtgccactgcactccagcctgggcaacagagtgaggccctttctctaaaaaagcaaacgaagaacgctgaacccaaggtcttgcctcaaaatcaattcccccttccccctccaacacatacaccgcaacagaatgatacagctattgtgattgctaggagaagggctttgggcagtgccagtctcctgtttgcagtaacacctgctctttctgaagagctacatcagtaacatggtgggttttcctcacaacttaaaagtctgatcgtaacacattcatggaaactagaaccagcacacgaaaccattggcttgtggccctaaagaaataactctgtgtccagaaaatgccatgttaccaggttgcctacagctttgcctgtaacatgggcacaggctgggacatcagatagaagctggttcccatggtggctgggttgggatgggctaagttatgttgcagtaacgtacaacctcatcattttagtggctagcatgacgaagttttatttctcatgctacatgtctactgtggctttcccggtggctcagggttctcagagcccctggcagatggaggctccaccctgtgggacgtcaccagttgttatggctggggaaggacacactggaggctcttgctgctctgagccacaggagacatttgtcatatctgcacacagcccactggccctgcggcatcctaccacctgcccagaaggaggagaaccagaattactgctgagcagctcctctgcatgtgggtgcaatggcgtcttatgactctcagaaagctactctagtggccatctaccagtgtcacacagtgtcacgctcggtcatggcctggaagatcagagtcacagagggataggacctggagtgtctctgaaaatagctgcctggtttcactccccggttttacgcctcttgagaagcagagtgatgcctagaatgagccctggactgggagggcacgtcccaggtttgaatcggggcctttgttccttttctgctgtatgactttggtcagatttctccttctgagaagtggagccaattaagcgatctccgatatgctgtaatctctgaaacatttcctcatatgtttctagcaacttccaacctgaggtctgatagacccagggttactttgcaagctaactgacatatcagtctcattgtctggtaaatctaattttaaccacttaatacttattttaggcttcacaaattattttaaaagaaaagataggggcataacaagaagaaagcttcggttacaatttccccgaaatgcctggatctgggattcctgcttcctggctgtgtggcagagaagatgaggatggccctggagtcagacgggactagggtccaagccccagctcttccacttgttaacaatgttctcagcctcagcttccttacctataccatggagacggcagtatttccttgtgggcttgttttaaggatccagtgacaggaagcatgcgaagctcttagaacagagcctggcactggtaaatagtcagtgagcagtagatgatattattaccatcctgtccctatccctgtcccccagcaaatattttggcttttaaatgttttaaatgatttcttgagaataagcaatgggtcagatgaaatctccttacctctcacctactggccatggcctaaatgtctgtagggagctggagccaggtgaggggagctgtggtttgggaagtgccgagttcattatgagcaagtgcacggtgctgggatgggctaggttccccgcacctcgccctgccactgcctcccaggacctgcctcttgctcccctgccacatagacagtctgcttgccccctgctttcagggacctcatggtccctgcccaatttaaagttcaaactctgcaactgcacaaagttgcaggcttggcagctgtgggacctgggcttcagagactccaggttcctcggcctgccccaggagggccctgctgaggtgaagtgggcataggagagagagtggacagagaatctgaatactgggtcacgttgcagttctgcgccttggatgccataggctccaggcccataagcccggcttcactaggcctgggtgtctgggttgtgaaatggggtgtctccttccaggattgccgtaaggacctggattcatccaagcttaaagtaaattgctttgtaaggtgggagacaccgagtacaggcgagggactttattaggtcagggatttaatcaggcatctgtttttacagatttctttattcctgttccctcccctccccttcctgtcctttcacaataaagaataacaacttgacacagcttagagactaaaaatcatccttcaataaagcagcagaagttgcaaagtttcctatgatgct

SEQ ID NO: 167 - DNA, 1940 bp, Homo sapiens
aggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggaaaaaatgtgccgtgtccttcccttgagtgctgacacagctggtgacaggcctcccgattctttaactgcttcaaaccagagtaagggcacctctgcctactgctcagcctagaaacccctgctgctcattgtgccccttcgcctgggcataaaccaaatcaatcctgtctatgttgatgcattcaaagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtataccct

SEQ ID NO: 168 - DNA, 1935 bp, Homo sapiens
caaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccagaagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagccttcccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgt

SEQ ID NO: 169 - DNA, 1753 bp, Homo sapiens
gtagctgttcacttggaagttaattaagaaagaacaaaaactattcatttggattcaaggtaggtttatgtgtgagcacccccgttgattggggttatggaaaggctgttgccaagtgggttagaccagatcatatcttggtgccactgtcttccatctttctagtcacctctgacctcacatttgtgtacaagtgatggggtggggtgagccaggattatgcctatgaggtaattggtagatattggggcaggaaatgggaagataagccacaaggagtactaggaggccagaagtgttatataaccaaagccctagatttggaaaggcagaaattgggtttagagattagagtgtaggtctgtcaaccaaatactcagaactccaatcccatctgtatttttgtccataggcctgcccatgagttaactatagggcatatcaacactgcaaacagggaaggaggaaaaattgcactagatcagtgcaggttggtgtgagtgctgcctgaatacacctatgaggtctagtggtatatattttagtggtggacctactagcatgggtccaaagagactgggcactcctttagcctttctcactctcagcaagcttacctgccatctttgttcctgtttgatgcagagtaaaagaatgacagtgcttgggcaggacattgttgagcattagtggcagtgtgcaaggtataaaattaagtagcagagttttttattaatccacttctacacaattcatttctactctcctatgtccttctgtgtggctgtttgcatagagaagcacagttagacaagactcaaagccagtttctttcttcaacctcaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatg

SEQ ID NO: 170 - DNA, 2323 bp, Homo sapiens
aatgcagcgcggcgcgctgtccccggtgctgatgctcagcgctgccccggagcctccgccgcgcccgcctcccgccctctccccaccgggctcgggcccaggctcgggctcccgccatggctcggctcgtcccggtcctaccccagagccgtcggggagcctgggcgcggcgctcgacagcagcctgcgtgccgccgtggcgttcaaggcagagggccagcgctgctatcgagagaagaagttccgggaggccatcggcaagtaccaccgagcgctgctgcagctgaaggcggcgcagggggcccgccctagcggcctgcccgcccccgcccccgggcccaccagcagccccgggccggcgcgcctcagcgaggagcagcggcgcctggtggagagcacggaggtggagtgttacgactccctcacgggtacgccgtcggggggtggggggatggggcacgaggggagggggcaatcgggagagcttggcgacttgggggccaggggccctggggctgaagggtccagggctgtgggcttctcggggagccttcagagcttgatcaaggaaagggattaggggtaggggatgacaggggtctgtggctggagggagctgggatgcaggaaatggtctttgggtcgggtattcagggcctcgcttcccctgagtcattctttccaccccctggccgcacgtggacccaaggtgaggaagtctgccctgagccaggctctcgaggtcccggccctcgcccccgcgcggggccttagtgctcttgcccaccgacagctctgggtggatcgcccagtggcgcctgtccgtgttttggcgccccctagcagcggcgcagttgcgcctgtttcgataggcgagcggattggcgcccctggttgccggagcaatcccttaggcctggttccctgccgcctggagcctcggctcctcgcagtcaggtgggttctgggggtgccagcaggctctgagagtgccggccgcggggccctcgcagcttgcctgctgcagtcggagctggtaaactacgagcgcgtgcgcgagtactgtctcaaggtactggagaagcagcagggcaacttcaaggccacctaccgtgccggcattgccttctaccacctgggcgactacgcacgcgcgctgcgctacctgcaggaggcccgcagccgggaacccacaggtgagtggcggggcggggcagaggtgagggctgggcccagggcggggaaaggggctgcagcggagggaacaggcaggaagatcagggcagaatagcagagccctcctcccgcggagctgcttctaggtagggctgcgccacccacctactccctacacgcccactcatccattcatccaccccgcccttcacccgccattcaaacatccgtccacctatcgctcctctgacatctccccggccatttctcatctaccgtcattgccacatctgatatctcctattcacctgctcagtcacttccctatccacccactgtcatctccattaccccgtcccacccctgcctaccgcacacactcattcctccactcacccattcacgcacacctattcattcacttcctgcaccatccactcatccactcgggtgggcgatgccaggaaattggggtgtgtgtgtgtgtgcgtgcatgtgtgcacttacacacatgagtgcaggagggcagacacaacactcagttttgtattaagagccaatgaagaaggaagagggattacaacaggtgcagggttgtgggagccgagacgagattagttttcctgttaagtggctcggagagaacagacttcttgcagatgtcgctggaggatgagaagtgtgacgggagcctctgcgaagaggcattcctggcagagggtgccgcaaatacaggcgcacagaggtgtgcgatggctccgctgtgactggggactgccgactgtgactggggctttggggaagggctctggctctactggctgtgtgagcgagctgctggatacttcggagaatggggtgtgagccagggaggtgtggaagtcacctgctgccccgggacacccagatgatgccctgcccacctcccctgcagacaccaatgtgctccgctacatccagctgactcagctgaagatgaatcgttgcagcctccagcgggaagacagtggggctgggtcccagactcgggatgtaattggctgaggccaatccagggggacctctctatccctcgccctcccacctcaccatgtaacttcccccgactcatgtgtttgttggtaaaacacttgtcactggtgatcat

SEQ ID NO: 171 - DNA, 2378 bp, Homo sapiens
ttttctcctacttcctcttgctctctggcatttccccagcctcccaccgccccatttgagatactaggagccatttgcttgaatgactgttctagggtttccacttgaccctttgcaaataataccagtcagcttgcctgtcttggagttgaaatggtcctgttaaatccaaacgtgcttaggtagcgcaaacgtcgggactggtggaggaactgccctggcctagagaccagaaagggtagggtttggtgagagacacctgggttcagtcgctggattattgctttcctctctagtgaagtccttggggatctgcatggtattttgtggccgatgtgctgacatttccagagtgagcgtataatctttctaggtggagtggccaacgcttgtaaacaaaggggaggggcaacagagggtccctgggtcactctaacctctgaccgactaacatctacagcctttgggtgttttagtaagaatcctgggtcccataacatcagaagtggttgccgacagattccaatcctactctagatttttactttcatttgaacaggtagacccactttgtggagcttatcatttcatttccctcactgggaacaggatgcctaggtcagtgccgggctcacactgcagtctatcccagggccagttccatctgtgccagttttggaataccgggaccacagtatcagttcacccgacaactaccactccccaagccttcagcgtggaacctgaggacgcagggagggaggctttggaaatgttcctgccaggacagtgccttttttcctacccaaactcccgagtctccgagctcaataacgcaaggatggctgaagagcgtctgctccatgtctctttgccggactcgacgaccctcacccactgccaccgagtgctaggcccacagaggcctggcagaagccactcacccctcactactcatgactaggaagaaagtggccggggcatgagggttcgagttctgtcctaggtcccggaagccagggctcccagcgtctagtcaggggcgcagaaaccctcgttcctccaaacccccgccacagggaccactccagaagaaacccattcgtgatttgggtccctttgtgtttgagtattgtggggagtgggctatctagactctaaggactccaagctaacgatgacctgtgtgggccttgctctgaacagaaaactcaaactcagcgtgggttcccgcgtcttccccaaaaggccaaggcccaaagaacccttttcatttggcgaggggcttgaggaagggaggggctggggcgggagagggtcggggtctgcaagccagcggcccggcgcagcggacttgtccggctgctcagcttggcagctagcgtccgtgccggcaacgctgttaccctctcctgggctggagagtggggacatcccttccccgcccctaggcgtccctggggtcggcgccagggcccgggagcgccggaggctctggctggatggcggcgaggagggctctgagtcctctcccggccaggccgagcttagtatgtggaggcggcggcgggagtgcgggcatggaccaagggaagggggacacccaaaccgcattggtgccttcctttccctccactcgcgccgtagacctccccaaattgcccgtctccggtatgactgaatctgtctgctggcctctcagctaccaactctgcccgaaatctagatcccagacctggtaagtcgcgttcctcccctaccccgccccgccaccttactagcggactctgcccgcgacagcgtgcgcgcgcgtggcctgaggcgcgcgctgagaagttgggctgatttggaactgctgcgctagttcggcctctgccgctggggtgtatacgtttatacgccgtacgctccagggtagtcaggaatgtcgcggggctccccagtgaggcgggagcgaaaagagtgcaggcccactcttctggatcctcttggccctgttgacaccaaagccatcttttaagaataagctttctgctggtctctaaaaggggaaaggggcagcgggggaagagaattgtccctttccctaagcagtttctaatcactaaggtcttcaacaaagtttactgggcggtttccatttgaatgctgtgaaattgttattattactattttaagttaaggtttctaagagtcacagcttctcaaatatacgtgcctcttgaggatgcttcgacaattaccttgtccactaactgcacttccttcccactggaaaaaataaacttaatttttcagtacttgccttaggtcacgtcgtttacatgtcactaatgtgaagaaagaagtaaataaagaaaaacaaccttggcatttct

SEQ ID NO: 172 - DNA, 1647 bp, Homo sapiens
ttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgctggaaagtctggcagcccaggccataggattccagttcagcctacgatttcctagggaaatcaccaagttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgcgtgtgcatgcgcacacgcacacacacacacacacacacacacagtccagcaccctcatcagttctctggtttaggttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgaagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaggcattccttactggcttgctaccagcaattgaactgtattctttatatagctagagctgtttgtgtcttcttaaaataaactttttctgttaaaatc

SEQ ID NO: 173 - DNA, 2374 bp, Homo sapiens
cggacctcgactgcgaattactgtttatgaggtgactcgctggttctatcggtggacagtgggacattctgaagggaggcaaggaggcggactgagcgctcccaattggggtgagcccgcccgagcggagagtggacggcgggtgtccagggggcggggctttcggctgtggggttcggtcgtagggcgggaactccccaactggggtgcgctggcgctcggagggggcggggccacaggccgcgaggctgccgggagccgatgacgcccgaacgccgaacctattgcgtccgggaggaggcggggctacggattcggccgagccgagaacacccgaacgtcaaattgctggcgttcgagaagggggcggggctgcggattcggtggagccgaggacgcccgaacgccgaacttcctgtgctcgggagggggcagggttttgtactgtgggagtctgagagcgaggaggtccgaaagccgaatcacagtcgttcggaaagaggaggagcgaaggctcgagcgtccggaagagggtgtggcctcggcggtgccttagcctccagagcttctgaccgctgacgggaacacccgaagggggacgcccactttgcaagagggtggtgccaaaatggacctttgtaagggggcgtgtcgccgcgcttgcggaggtttgtttttcacgctccaaggcgcaatggtaggtacggcagtgcgggcacagagcgggtgccgaccgcagggtcacaagggtagagcgggaccctgggggcttggcgaggggagagggtcgggggcttgtctccggcgtctcgtctccggcggccgcgaggcctggtgggatcgcccgggggcggggcctggcgctcgggcccagcaggtggtgaacggcggctgagcgaggccccgccccctgaggcctaggggcggggcttcgccgagaccccggaggctttgggtgcgctgcagcggtccgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggtaagggggcggggctcgaactcgggttcggtgggagcgggacctgggagtcaagtttcctggcttctgaagggaccataagcttggaggttccagcgaagtgtgcttctcaggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 174 - DNA, 1875 bp, Homo sapiens
atccctgcgccaaatgatgagctttacatgttttagcacatttaactttcacaggactctatccccattacaggtggggaaactgaggcacagtgctttcttcccacctccactgaccaggtcctgggggacccagggtacccgccatcccatcctgcctccctcgggagctgtgttcattgacttccatcacaccggcgcctcctcaaggggctcaatccagatgtctgctccagacctctccacagccctcagaggggtctgggatgggagtcctggccacgtgatactatcctgtatagccgagcagccaccaagtgggtgtgtgtgcactgcacctgtgtgcatgtgtgattgtgcctctgcatgtgtgcaggtgtgggcctcccaggctgagtgtctgtgtgtcagtgtcaggaggtgtgggtcagagcatgtgcgcatgtgtcctcgtgtgcagtgagtcagcgtgtcctcctgcgcccccatgcatgatgtgaatcagtacgcacgagtacttccccacaggcggtgcggaatcgtgtgtccgcgtgtggatggcaggccattctgcaggctgcagcgcgccgggggcttgtagggctgagcgcatgctcctctgggtttgctgcccactttacccagctctgtgcagctggggagaggggcggcagtggcaggtgcggtactggtctacatgagccaccgactcttgtccaatggagtatcctcccaggggagagctgtgtgtgcttctgtgtgtatgtgtgtgtccccgtgtgtgcacaagtctctgtatgtaggtgtggggaggcattccctggaatatgtgagtgtgtgtgtatcttaatccatgtatgtttgtggggggcgtgccctgaagtgtgcctgtgtgtatccatgtatatgttcatggtgtgcattccctagtgtgtgcggtgtgttccccaagtagacggatggggagggaggctccctggtatctgtgtgtctgtgtgtgcatgtatctgtgatgtactccctgggttgtgtgtgtttgtgtgtctgtgtacttaaacatgtgtgtgtaatgtgtcccggggagtatgataagtctgtgtggtcttctccatgcatgtgtgtatatttggatctgtggatctgtgtggatggtgtgtgccctgggtgtgtatgtctgtgtgtctgcacccactgcagcagtacccaagcctgccaagggcaccatttgcttgaagatgctttctggtgccaactgtgcctgccaaggacaggtgaccagacagcattagacaggctgtgacctgaacaggcacggccagagccaagggggctgctgcagctccttctccagctgtcactgctcccagcccttcctgccccctctcctggcacatcccccaaggccttcaggctgacccctggatttcagaacacccctcttcatcagaacgtatccagcctgggttccatgcccatcaacagcaagacaccagttcccctgcataaacaggtgctgaagtcaggaggactcaggcagacacactgtacacatcaccgcaagctctccttcagtcctcccaacgactataagtgaggtgttaatatgcctgttttacagataaggtaactgaggatcaagaagttaagtgatttgttcaaggttgtcactgcagcagttttgtggtttcctctctaagatggagagaagttacaccaggacttagtgcctgggaagcaaagaggtgaaattactcggccaggattgcacagctgacagtgatgataccgatggctgtgcttttagtagctgttaggtaccaggaactgtgcttggcccttgacacatataatttcacggaatcctcacagcagatt

SEQ ID NO: 175 - DNA, 1748 bp, Homo sapiens
cttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcatctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataat

SEQ ID NO: 176 - DNA, 1851 bp, Homo sapiens
gcgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgggccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtgagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgtttt

SEQ ID NO: 177 - DNA, 2231 bp, Homo sapiens
atttacacaaagtgcttaatttctttttaatgcatcaaattttattatttctgacatcttactgtgttcatgcagctgtaagaaaagcacagagcaggctgggcgcggtggctcacgcctgtaatcccagcgctttgggaggccgaggtgggtggatcacgaggtcaggagatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacccaggaggcggagcttgcggtaagcagagatggcgccactgcactccagcctgggagacagagcaagactctatctcaaaacaaaaaaaaaagaaagaaaaggacagagcagtttctaccccaaaaattcccatcatgtcatatggggacaattagaatgtaattatgtcccatacttatgcttctgtgaatttttgtgcccagctcaaggcctcagactgccttctgtccagagaagatgatgatggtgatcacagcatggtgccacaacctacacgctgcctgcagctagggcctctcaccagatggttgggttttcaacccagctctgtgaccatggctgtgtatatggccttgggcagtcacctgccctcttggtgcctcaattgtctaatccatagaatggagataatgtcagttcctactttgtggggtagttatgaggctgtaaggcactggtcagtacctggcacaccagttgcccgtattatttatgcagttgttttatttttgtgtctggggtaccttcccactaccccaacccacttctggtggattatgcaaaatatttcttttctttgagctggtgctgctgctgcttttctcaggtgtctgggaatgggactgagctgccttacagaggcggcgcaggggagcatcccgagggcctctgtgccataagaatggtttctcttgatctctccccacagggtgtggccactgtaagaaaatgaagccggagtttgagaaggcagcagaagccctccatggagaagcagatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgcgtcaaagacaagaaccaagacctgtgccagcaggaggcggtcaagggctaccccactttccactactaccactatgggaagttcgcagaaaagtatgacagcgaccgcacagtaagtgggggagaggcgtctgcccagagctctctctctgctgatgggcagggaaacttccactgaggaggggcagcactgggcagcatcccagaaactgcagaagtcagctggaacactgcaccgagaggcccaggccctgggcctggctgaggcttgacattgttggaggagagtcccaaggggttgccacagatgtcctgtccccagaggcaggctggactccagatgccgagggttttctcacttgctggtcggggctggtgcaagccacgcagaccctctccaccttgcagaagtctgcccacctctccctgtcataggagtgaccccctggaggggctgggggtgtggggagagagagtgcacagccagctcagggattaaagctctttctctctctctctctcccacttccctgcaggaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattt

SEQ ID NO: 178 - DNA, 1698 bp, Homo sapiens
agccgtgccagaattctctgccagctgctgtgcactgctgtcagtgcaaagatgggatggacttttttttcagattttctgctgttgtgggagtatggcaagagtttgagggggcggagaaagagattgggaatgtgaaaagggaagatagcacctgcgctaagcacattcctaggattgggccgcgtctcggggatgcagagtgggctcttcggcgcgccctgcagccgtgggagtggacgcctgcccaggccgaagggcaaggacttgcggggtggggtctctgtgcatgcgcggagctgaaagggagcgttttgcagatctccacgcgtgcgcaactctcgggacgtggacgcggtgaacagttacgcacaatcgtctttctgacacaaacacaccctgccaggtggaagccaggatggagggcaggcctcgccttctgtcccggatccgccaatcctccgatccctggatcctctgatgatggcatcaactgtctgggctacaggttgctctccaaagagtggctgcccctctacaccaacctcactgtggacataacttccaagcctcaggagacccagtgcaaagctgaggggtatcttatctggaagccagaaagagcccctgaggccaaggtcacagggaagccctcccactcaccccacctggtttcttttaaaagtagagtttattttatctcctttctgccatccctaattccttccttccatctgtccatccatcttctttcccctccctcccttcctcccttctccttctcctcctccccacacctgcttcttttctctttctttcaactatgtccagaaggtccttcttaacaaacactaattagtacagggaaaggtctctttaagtgaatgcatttaaaatagggagtccacctttgtggtaaatagtgtgcacgaggtgagtctggatcaggacttcacacttgataacggaattcaatttctcaaaatacctttatttcagatttaatgaaattccatgtttgttgaatcattaagaacgagcatttgtgttgtactcatggtggacagccaccattccaatgcttgactttacataattaacgcatgtaatctgcaaaggagccacaaggcgagatctattattattcccattgtgccgctggagaaattaaggcagagaggttaagttgcttgccaccaaactagcgaggggcagagctgggatgtgtagcatccaggtaggttggctccagagcccatgagcctaactactactgtgcccaacctttgtgctaatccccacaacagtcaaaggatggatcaagtactggttttgggggtgggggcaggggactctgggcagtatgttttctgatcacatcacatgacagtaggacattcttcatttcaccatggctttcactgcccaacaataaaaaggtcatgggcactttgggaggccgaggggggcggatcacgaggtcaggagatcgagatcatcctggctaacatggtgaaaccccgtctctactaaaaatacaaaaaattagccaggcatggtggtgggcacctgtagtcccagctactcgggaggctgaggcaggagaatggcgtgaacccgggaggcagagcttgcagtgagctgagatcgtgccactgcactccagagcctgggcgacagagcgagactccatctcac

SEQ ID NO: 179 - DNA, 2510 bp, Homo sapiens
ctaatcagaacccagcaattacttcatcttcagtcacccacagagtcactgctgtttgtccctgcccctgggagaaggtagaaagaaacattttctgccttgtgccccaaagcacagctgttaaaaataagagtcccccttctgctgttcgttgtggccgttgctctcaccctaccacacagccctgcccagcccaggaatcaggctcctctgacatgctacccatttcccattggctccagctgtcagattgcctgaagaaaatgtattttctgcctaagtctttaaccaagggctaaggcaacagttagtaaagactaggagagagaaagaccaaggggcccacaggctgggaagacaggcaggtgcttattctgggccagaatgagtgaaccaaggtgcgagaatgggcggccacacgtgagggctttggtactgttggaaacatctataaagttctagtgaagagtcccagagcacaggaccctgacctcaggagagaaccgaatcagggtttgtatacctgcctgcatgctctccctcccctcaccttacacctcctgcccccctccccaaaatgtataaaggaccaattgtattgcaaacaaagaccatgtaaaagaaagaccttcaggcatccccaactcttaaaaggctctgatcccctgagacacagtgcctgtgcgatgcagagcctcacgaagaactgaaaaccaaggagagggcacttgcagatgacgttgctcccatggcagcgtctgtgcccgtgggcttctctctgtggaaaatggtggaggctgcttctgccccaggagggagaaacgccgactccctggctttggcgccagaagcctggatcggctgccaggtatgccagagcagaatggggatccaggggacagggcgacgatgcaactggatgctgtgggggggtcgatggtgatggggaaagtagaggtatgggtgagctgattcccttttcctccattccctcaggaggggtcctcctgaggtcgcagctcccctgatgtcctttcccctcttcccaggtgacttctatttctatctggttctcgtctgggggggccctggccgggcagccccccaacacttctcctgccctgaaacacggctctagccaacctgctccgctgcttcacctgcgaccgtctctgcgggggctgcacggcgccagcccctccagcccaccagggcattgtcctccagcccgtcatgcccagctgtgaccccggtccgggccctgcctgcctccccaccaagactttccgcagctatctgccccgctgtcaccgcacttacagctgtgtccactgccgtgcacacctggccaaacacgatgagcttatttccaagtccttccaagggagccctggccgagcctacctgtttaactccgcggtcaacgtgggttgcgggccagctgaacagcgcctcttgctcacggggctccactcggtagctgacattttctgtgagagctgcaaaaccacactgggctggaaatatgagcaagcttttgagacgagccagaagtacaaggaagggaaatacatcattgaaatgtcacacatggtgaaggacaacggctgggactgaggggctcaggcagggtgtgcccttcctccgcatgcccctccctccccacggccctgccaagcagtctataccagcatgagtactgccccacccctgggggaaacctggctccaaccaacccctcccctgcctccaccatatccactaccaggcaccctttagaacaggggtctgggggtaccccaggggtgttaaggctcaggagtgggcagcagtcagggagagacagaactgggggaaagggatggttgtgggtctttctgttcccaagatcctgaacatggaagcgatggcagggcatagactcaggcagagaggattgtgggaggaatccgtttttgctccacctctttttgagtgaacagaggacaaaccttgggtcacagggcaagtagatcatggaccacagaacagcagatgagaaaagacttgggttggagtgaaattctggtctcagacaccaggagaccagagtctctgaggatgaagtttcctacccctatttgtagggaaaaggacttgagtgcagggaaaactcaaatcccaggccctgggaaatagtaaaataatcaaagggttttccatttcactccacttgttagtttatcttggcactgaagaggcgctttcgagtatctaacttttgccattgggtggggtggggacagctgctcgcggaacagcccctagtcggctgcttccagagtaagcagtctttatgggctttctctgaggcccagtcactgctcctgggacccagtcccctggaggggaggtggaaaatcagtgctacggggccagtctttcccgtggctgccaccagcgaatgaaacttttgtatgatacataaagtgcttgagtctatttttaataaaaagggaaaaagcaacttg

SEQ ID NO: 180 - DNA, 2532 bp, Homo sapiens
cgccgttacctctccctgtgccaggagctccctggaggctcgtgtagacccacttcctctcctccccaggcccagcacagagcaggccactggggaggggaacggataccctagggcagtggccacagggctggcagctggcctggtgcaggcgtctcggtgggggcaggatacccaggagcaagcagagccctgtccctcctgccctttccccgccccagtcaggcccctgtaatctccgctcccaggcagcgactggctgtgctatctggcctgtggtttgtcgttcccctctgcgggccaggctctgttgcctagctgataccagctgccgtggccacgtgctccaggcacttcccgcggagccactatggccccacctcttgcagtactcacagcggcccatggttaccctgtctgcagaagttaaaatgggcttcgaaagcttgagtcactgcccagggtcatctagcaggaaagtacatgatctggggcgacctctaaagcccagccctttatgcgacacctgggcctggtgccctcatcctacctgggccccgcctggcccctcagccttgtgcccaccgcaggtgcctgatggcttcatctcccatttctactccgtatcggagcatgtgagccctgtcctagccttcggcttccttggacccaagcctcagcttgctgaagtctgtgctttcttcaagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacg

SEQ ID NO: 181 - DNA, 1753 bp, Homo sapiens
agtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtggacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgct

SEQ ID NO: 182 - DNA, 1381 bp, Homo sapiens
agacagcctcagagctggtggggagacagcatgccactggaaaaattcgtagacatggaattcctggatcaaatgatactaagggggacttgcctggaagcagacttgtgtccgcagtatacaaactcaccctttaatgcacacactgaccagataacacaaacacatttacccccacagcacctagactcttctcacagtacacacacttgccttccagtacacagacatatccaaaggcacaccgacaagcaccacagcaaaaagatgttccccagaacacatggacaccccaatccccgtatcattagactctcccagaggcacgtatgtactgcttaatgcagagactcacctgaggcacactgatgcaccccgcatgacacagacttgcccccccataaggactctactatgacacacagacaatcccaacatcacacactgttcccacatcacacgaacccattttaggaaacacacagcatacagacttaccccatagaacacggcttccccgacaagcacacatactctcaaggccagtagactcaccccacagcacacagactttctctagagtgtacagcttcttcccacagcaaacagactctccccagggcacacagacacccctgacatcacatactctcaccacagaccatagactcgtcctagagcacagggactcttgccaatgaaacagactttcccgagaatagactcatgagacagcttgaagacccgcatcatgacacaaagactctcccacaacagacagactcaccccattgtgtacagacaagcaccatgggccacagaccatcacctcaggacacagacttgcccagcaccacacagacactctgcagagcacgtagagtcaccccgcaaagcacagactaaacccatactacagagactctccctatagctttcagacaagtttaccccaccacagagacatgcaacggtacatcttacaacatatatcactccttgatgcacacaattgtgccacagcacacaaacttgtcctacagtgcacaaattcatgtcacaaaagacacactcaccacacaatacaaatacttgctccagccggacgcggtggctcacgcctgttatcccagcactttgggaggcctaggcaggcggatcacctgatgttgggagttcgagaccagtctcaccaacatggagaaaccccgtctccactaaaaatacaaaattagccgggcatggtggtgcatgcctgtaatctcagctgctccggaggctgaggcaggagaatcgcttgaacccaagaggcggaggttgcagtgagccaagattgtgccactgcactccagcctgggcaacaagggcaaaactttgcctc

SEQ ID NO: 183 - DNA, 2297 bp, Homo sapiens
gtatttaaatttgaagggaaaaaaaagcagtactatagcacagaggtgacagctacaggtgtggctacatccaggtcctaaaactatatcatcagaatgacccctcaccctccccccgctttccattttactttcttaagcatgaacatgaaatttccaagattgtctctcctttggctaatctgcttctcagacccaatcactgtggccagggtggtggaaggacactggcatccaggctgggaccacatgccccagatccagatcagggtggggaatggccagtggcacacatgccgttggggactagtgactcctcagcggaaaatcaggaactatctttggagaggagcgatagaagaaaggctgacacagtgcaatgtgtctcctgcaccagcctgggccttgatgtcttgagtactgatgacacagtactcagtccagggcaatcccaactccatctatggggctgcccacagtacatggaccgcctcactggatttgctgaccacatgtgcaaacagccacctcccagccccactccccgcagtccccctgaaccctgtcaaaattcccctcagttctcaccaagactaaaagcaattctgagggtgagcggctcattctgctagtttaactctctcgattccttccctctccagaactctgtacttactgctccgtcactggtaatgacaatgaacatcttcacaatctcaggttttattgcaaagtgattgaggaccagttagaataagttatgctgcagaaactaaagaaatcccgtcaagcaaattgtgtgtcatagaaagtcttaggacagccgtgtatattttctcccccaatgaatcaattgaaaatgagaagctcttaccgccatgttccgggcagaagctatcaaaagtataagccatgatattataatttgatgatttttcatgcgtcaaatggttatggcccaggggtgaaaagtggatgctccgtaactagatgatggtcaagagttataaaaatgaggtcctctctgttcaacatttctcctttcttgaaaggatactcaatatcatgctcagggcctctaatggccagaaataaagttcctcccagttccagagcaccccaggataaccccaaaaccagagcaactgcttatttccatatagactatatactgtgcaactcccggggtggcattttcataaatatgtgggtggcgccccctggaggtaagcaatgcacaacttgcacaaatggtaagacaccgtatcccaaagtccacaaagaagagctaagcaaaactcccatcgatgttgccatcggtaatgagtctgccttttcttcatgggacagtagcaaaaacaatttggccaagtgtgcttggatgatctctaagatggaatcagggtctctcactttcagcactattgacatttggggctggatcattcttttgtcttagtgggagttgtccggggcattgtaggatgcttagcagcatcgctggcctctacccattagctgccagtagcaccacctcctccagccgcaaccaccaaaattgtctccagacatggccacgtgttctctggggggcaaaatcaccccctggctgaaaagccctgaagtaaagacataatatgcagatcacatgtaagtaagggagcctaagggccacacaggtgatgctgtacccacgacaaagacagagtcttaaagaggttagagaggtggagaaagagaaaggaaatgaagtcccagttgcctagagcaacagatgctgactagatgttgttgatagtcatctttaaactgagttaaaagatgctgagaagccatcagctcccatcctgctctccagggacaacgctgctgaaaaaaggcctggagatcaacaaagtcccaaacacaggtgcactgagcaaagaaaccagagattgagacaaaatgacattccctcaaagactacacatttccaagaggagggaaaaagtggagtcatgaaaaacagttgaggctggatagagtgactcacacctgtaatcccagcactttgggattactcccagtctgagacgggaagactgcttgaactcgggagttcaagaccagcctgggcaacgtagcaagaccttgcctctagaaaaagggaaaaaattagccgggtgtggtaatacatgcctgtggtctcagctactcgggaggctgaggtgggaggatcacttgaacccaggaggtagaggctgcagtgagccgggatcgcaccactgcactccagcctgggctacagatcctgtccc

SEQ ID NO: 184 - DNA, 2252 bp, Homo sapiens
agcttcagggcagaagagccacagagccaaatgctgcagagatgaagggagacggaaagagccaaatgctgcagagatcaagggagacggaaggatgtcgcctccagagctggggccacgggcagcgccagggcaggttcatcactgatggcaagtctgtggctgaccacgttcacaggggtggccctgagcaaaggtcggacatgaggacccaggagaattcaggccccggctctgggacggctgtgcacccccaccctggccgtggctggcacctcagaaggcacagctgtccttcactcgcacggagcaacctcgggacagatggtgggagaggaagggcaactcgaggaggcacattttaggaaactgcccacggagccagtttcgattctccaaacctcgtcagcatgcagaggctccctgactcggcagcaaggagggcctcaccagccgacccccatgcccggcacccccttcaccagtgggtaaactatgctcgccaccactcagcactcacctcttgggctcagagggcagaaagtctgacccttctctcttaaaagcagggtcctgaaaactccagagagcagtgccctgtgcattaaacacagactgcgcccttgtactcaggtatgaccatttgtcctggacaaaaattaaactgatgagggaacaaaatagggccttatagaaggtgagtggaaaagcagggaaggcaaacccccaaattcaggagggaggatggaattggcctggggagcagaggcaggaggttctgtggacagggctggtggagctctggggggagcagaggcaggaggttttgtggacatggttgatggacctctgcggggagaagacggaggagattttgtggacagggctggtggagctctgcggggagcagacacaggaggttctgtggacagggctggtggagctctggccacttcctccgtaaactagagacgtgatccccagggccaggtctgtctctgaggtcctaccagctgggacaggtaagaggctggggaaggaggagcgtgtgtgtgtgcgcgtgtgtgtgtacaggagcatattcaatgagcacataggtcaaggctgctgatggggaaggcaagcccctcgtggagagggtgggcatccacccaggagcccgcccagaagtgttcagttctatcgacatgaaatttccatttctccttccctgctggaccttgggtgccctagagggtccctacatcctcctccttccctcccttcctgatgcccacacagagcctgctgcaaagtaggtgctcagggagtatccatttaattcaactgtatttcatcagagagatgtggctttcccagacaaggaagaattcagaaaacagcccagacatgctcagagcagacagctggactctaaccaggctctgcgacttgctgactcacaggccgtttgtccctcaagattccccacggggtagtcggcctcaaggcagctccacctgacggctgagctcgctccttgctgaggggctggtgcccccaggagcctcctctgggaagctgagacctcctggtgccacctcgaccccgccgggcgacacacgctgagcagaggcagcactcgggctggccggcccagcaggcagatgttccggaacccttgtaaaaccccgcagtacagggactaggaggacccgaggggtacagggaacggaacaggagttgccggtgataatttcccgaaaaattcctaggggacagaggctcatcagccccaggcaacttcctgagacagatcggtaaaaacaaccccttcttccaggaggatgcaattctctctctaaagtcgagagctcaccaccccgggcgttcgtcactgcagacatcactgcagacacagagacggccattagagctcaccaccccgggcgttcgtcactgcagacatcactgcagacacagagaaggccattagagctcaccaccccgggcgttcgtcactgcagacatcactgcagacacagagacggccattatgcagcctcacgtggtcactcctgggggcggtaggatattttatcctaaagagaaaacaccttaaattctcacatcagccacccccatggcgactcttaacaccttaatgtagcaccttccaacttttcctgggcatttatgtacaaattgtaataaaattgggttcttactgcatacgctgcttgctggtttctaaataaaattgggttcttact

SEQ ID NO: 185 - DNA, 2299 bp, Homo sapiens
tgtggtactttgctctggcaaccctagcaaagaatacagagggactaaaaggaggtccacggatgcgctgctgaaaccaggaatccaggtcaggcccgatttgtcctgttccaactagagatgtgctcctccttcaggaagaaatcctgcttttgccagaatgtactcttgtctctccttctggccctttgggctcaagagttccactgctgtgattcatgcagaacaaagagggagcgcctcagcctggctgtcaagcccttcatccattcaccgatgtattcattcagcaagcgactgccagccgcctatcaggagagaggtgagttctgctcacggggaacatccccttctttttccctgggaaaatctgcaacccaagcacctatcttccagaagacccacctccttctcgtctcctctagttatgagcccttgtcccggctgtcacggccgtttatcacactcatctccagtcctagctcagcttgcccacgtccaactcaaatcctccttttccacgaagtcttccccccagactccatgaactttgtggttcatctctgttctgccatcacctctcgcttacctccgactgtggccctcgccatcatctgtctgaggtcttagttacttatctacttgaccgtgtccctcactagatcaggacttccagagtgagccgttcaatcatctttgtgtccctagtacagagcctgtgcagaacgggcactcaacagtgtcttctgaattcactgatttcgtgctgtgtgctctggggagctgcaaaagggcaggacgcgtctgggctcccctaggcaaaggtcccagtgctgcagcccaaggcatcctctgtgtctcctactagggatcccacttctcactctcgatgtggcctcccctcgctgcctgttcatcccggctcactccctggtcctgcactgggggctggaacacagacttcctgggggtcccgccgtggtgggagctcctgggttccacttgtttgggttgttttagattcttccccacttcagatgaggaaaacaagagccattctcccttctgactttccttccttttcttttctcagatccctccagtgtaggagggtgggagggagagctggtccaggggtgaggggagactcctttctcacagggagttttcagataaaggctctgggaatcctgagaagggtggaaggtgcaggaatggacgccgtggagtacaggctggctggctggacaacacacacttcccattgagccagcaactcggatttaggagccagcagatggtgaccgaagtgccctgctctctggaagtccaggcaccagctcagctccacactagcctaggccctgcaagcagaataagctgaccctccccaacctgccggccacccattcaggagcactgctgggtgtttatccagcaacccttagagctgggcttcagggttgggccctgaattcaaaccctaattttacgtgacctagtttcttgccctctgtgagacttcgtgtcctcacgtgtgaattggggtgatgatacccaccccaaaggcctgcctcaaggtttaatgatggtgtgcatggaaggccctgggttcagggactggcactctactcatggtggttctcggtagaatgagaaccccagagagagcttccccgacagctgcagggaccattgtttttctgctgttgaccttccattatcctctataacagtatcccaattttgctttgagaagttgccttttctccactgagcacagcctggtagggctggaattaggactccagtaccactgccttcaccctgacaaggggtaggcacatgcctgtgtgaaccctgagagagccagcccttcgagatggatcctgaggggctatccgggtctgaattctgagtggcgctgaaagccatttgcctactgcaggttccctacatgccctgtgcaagccgaacagtagctcaatgttggggccttcttagctgtctgttcctgctcacactgccagaatcaactgctgccgacgtcctcattctaccacctgaacctgaccaatgaaatgtgacccgtggtcaactttaacatcagcaaatcagaactgaacaagcttgcatccctcagatgcaatgggaactgggattagaatctaagcagaaactttttctatgcaggatagcccttctctttgttctggcagacgtgcctttgttttatactgaaggctgagtctccccagttggcaaactgctggttggaataaagactctttttaaaaac

SEQ ID NO: 186 - DNA, 1811 bp, Homo sapiens
actgcaacctccgcctcctgggttcaagcgattctcctgcctcagcctcccgagtaactgggactacaggcacctgccaccatgctcggctagtttttgtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggttgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaaggtgagctgagagctgtgggcccctgaaaaggccatgggtgggacatctaagacagcaatggttctcagatcttcagaaggagggaaagcgcttgctcctgtctgttgtaggagcctggcccggagaggaggagccaccttccattccttcccctgatagtggattgtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 187 - DNA, 2612 bp, Homo sapiens
catatttcctctgtaaggcgctttactgccttcttgagcttagaaacatgagacagcacctcagcaccacacagggggaccattttaaacaccagaatcactacagaaagcacagaaatacgaaaagcctggcaataaatggaccacaaaaaggacacttctttacaacctgatatctgaggctcaacctgaactgggaacttgggcaactcacatttttttgccaatctgcacatgtccacaaataaccacaaacagtgccccaattactgatttgggggttacaaattttagcaagtaggccagctttacaagtacagaattcatgaataatgaggatagactgcagactgtctaatcgtgcacgtgcgacaacgtgtggtgcaaactgccagggcgggacagagcagcgtgtgctgcaagaggtgaattctaactgtggagtaggacagagttagggtgggccaaacacacactagtcattaagccaacagagccgtgagaacagaaacagtgtctgttttgcacagtattgtatcccccacatctggaagaatacttgcagatacaggactcggtgaatggagaggcatggccatgaagtaggagaggatcttttgcagacagaataatcgggaaggcccctgcaagaaagcaaccactgagcccacccgaaatgaggaagcaagtcttgcagaaaactaggggagggggtgcatcccaggggagaggacaagctgagcccctgagggccagcagtggctggtgtggctgctgcggagaggatagagggcggcagggccagatcacagactgcaggagccacggaagggtgcctggggccaacccccatccccttgccgtgaatccttggcagccccttgttgggctcagccctagcaaagcaagggttctctctgcccctggcttccctgtgtttgaaggggtggagggtctccatccctccttgaggccttagctggtgcctatcttgtgctcagcactcacttgttttgtttacaacattgcttctgtttgttgtgctccaggcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggtatgaatataggtggtttgttgtttttgcttttttaacaagaggagtttttcatttcaactgtgtccttaatacaagccagattaaaaacttgctggactataatacttaagtgacttttatccatttttttctaacattatgaacatttaactcaaagaagggaatgtcgtatttcataagatgttactgagaatgaaaaagactgggattgaaaactgattttcatatttattgtgtgaacttggctggttatctgcttcaatttgtccaatgggcaagggtcatcaaatttccattttactatctcattttaaaaacacagatcttccctttggaaattacgtgttagatgtttatcctcaggaaaagggattggaagtggtggggcttgggcacccatctctggctggcccttgtcagttggccacatgagtgaccacagctggcatctgtggaaaacgccctgaatgtttagccagtccggtcacagctcagcccccagtgttgtcatgtaatgatgtccccatgccagactggtgtgactgcaaagcggagaaaagcattgcactaaattcaatgcaaatgtcgagccttgaaaataaaattgaagtaaggaaggacacattaaaaaaaaagatcaacaatggaaggaggctgggtgcggtggctcactcctgtaatcccagcactttgggaggctgaggtgggtggatcacctgaggtcaggagatcgagaccagcctggccaacatggtgaaaccccgtctctactaaaaatacaagaattagcgagcatggtggcacacgcctgtgaacccagctactcgggaggctgaggcaggagaattgcttgaacccgggaggcggaggttgcagtaagctgagatcgtgccattgcactccagcctggacgagagagcgatactctgtctcaaaaaaaaaagaaaaagaaaaagaaaaaaaggaaaggctcacaagcaaagaatatcagagatgggacttgatcttattttgagagtcctccagcacgtgatctgcctcagctgcagctgtggggtagcccagggtgaggctcacgtcctcatcctgcccctcgccagtggggactgagttcaaactcaggatgcccagtgaaactggaattacagataaataatttttgaaatcatactgtttaaactgataaaattactgttatctgaaattccaatgtgaaatcatactgtttaaactgataaaattactgttatctgaaattccaatgtaactcagcatcgcatatgtttatttgctaatctggcaaccctaaattgggaccctgacatttaaaatatggaataatgcacaggctggttgtgatgttagatgacataaatttgcaaaagacctggcacacagcatgacctcagtagatgtt

SEQ ID NO: 188 - DNA, 3183 bp, Homo sapiens
gaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagaccctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggacaacgtggatctgggagagctgatgttttccctgtgctatcttccaacggctggcaggctgaccattaccattataaaagcaaggaatttaaaggcaatggacataacaggagcatcagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactacgaccgtgtaggtcacaatgagatcatcggcgtgtgtcaagtaggcaacgaggctgagaggctgggcagagaccactggagtgaaatgttgtcatatcctcggaagcccattgcacactggcattccctggtggagaaacgatgaccatgggtaagaggactgcttgtgccaaggacaaaataggacaaccatctcacaaagatcttaagtaactttttctatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcagtgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacatttgtccactaagggaacagcctcagaaactggtacagcaatgggtgagatgagatcctggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctttgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaactattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttg

SEQ ID NO: 189 - DNA, 1992 bp, Homo sapiens
ctatctcagccgctttggtcctgtggaaccttgacctcaggcaggacagatgctgcaggcctcaggtggacagctgcccctcctccccgagtgctcatagccagtctgcaaggtcggggtctacgggggtccctcggggcagggccctgtggcacagcaatgtccccatctccatcctcacggccaccctcctcacagggcctggtggggcagagcccgtggcttcaggagcagctgtctcagctgctggtctcccacagtgacccagtcacggccgcccagtgtgccatggacctcttgctgcccgaggagcggctgccggctgcggtggctgtggaactccgccggttcaggctccaggggagggcgactgaggctgactcgaggctggaggtgaaggacatgaaggaccgttactaccagctgcccatccccagggagaacgtccacctcctggcctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggcactctcgcagccaccaacagggcagggagcccaggccttttcccggctggtggcccagctcctctcggacccctctatcaccaagctgggctacgggatggtgggggacctgcaaaaactgggcacgtcctgccccgccctggcccatgtggagaagcagattctgggcggcatggacctgctgctggtgcacagacagatgcgggtggcgagcgtgccagccccagccgtggacagggccagggagctgaggggcctgagcctcctggtgcagcaggtgctgggcacagccctggacaagacgcagcagctgtccaactgggaccggaggccgctctacgaggagcaggtcatctacgcagctgccgacgcctactgcctgctggaggtgcaccaagccctgtgcagagagcccgcccgcttccacctgtcggaggacctggctgggagccggaggcccaggcacagagagagaccaggggcacggaagccacccggcctgcagaaagcgtcagcaccggccgcacccaggcaggtccctgtggctgtggctgtgtctgagggcgctgcccctcagattccggccagggccttccgtgtggtgtgtgacaacatgctgcaggggctggcacggagcctccgctgtctcggtgtggatgcacgcatgctgggcaatggtgaagaccaccgcagggcggccgaggttgccaggcaggaggggaggatcattctgacgtcggggcagccattccacaagctccgggcccaggtcggggctgggcgctgcctctcggtcgactgctccctgaaggcccagcagcaggccaaggctgtgctcaagcatttcaacgtgcgtgtcacccacgcagacatcttcagccgctgccaggcctgtaactgtgaccagtacctaaaggtctccagggacatgatgaagcagctcatgtggctcagcagtcaccaggaggggcccaggagctcaggtgacgaggccacccagagccaggcggtgcaggagccaggcccagccccagacgcagcccctgagggctgcacctatgaccgcccctgccgctggctgcagatggctgacctgcgggcggagacaccggacatgctggccgacggcacccggctgcagctggcaggggtcccggtgggtgtgctgaggacacctgggctgcggtgcttctactgctgcacgggctgtggaaaggtcttctgggacggctcccacctgggtcgtgttgccacccacttccgagacatgctggagagcgcccccagcccctgcgagccgagcccagcccccagcccggccagcagtcccttctgaggacagccagacaataaacatggaaagtgcccg

SEQ ID NO: 190 - DNA, 1606 bp, Homo sapiens
agatgatttagggtacctggcagaagaaatttctaagcagcaaagcattcaagatgtgacctggtatttttctaaaagtatatgctcatatgtatgaagagacggtgtgaaattggaacttatgtttaaaagggaagcagaacataaaagtttggaaattttgcagcctcaccatgctatagaaaagacaaacccattttggggggagaaattcaagccagtggtagaaatttacataaataacaagaagccaaatgctaatagccaagacaatggggaaaatgtctcccagggcatgtcagagatcttcatggctgcccctccagtacaggcctggaggtctaagagggaaaaatggtttcatgggccagtcccagagccctgctgctaactgcatccttgggacttggtgccccgcgtcccagccactccagctccagctgtggctgtggctaaaaggggccaatgtacaactcgggccatggcttcagagggtgcaagccacaagccttggtggattccacatggtgttgggtctgtgggtgcacaaaaggcaagagaggaggtttgggagcctccaccttgatttcagaggatgtatggaaatgcctggatgtccaggcaggactccgctacagggccagagtcctcatggagaccctctactagggcagtgcagagggggaaatgtgggactggaaccctcacagagagtctccactagggcactgcctaatggagctgtgggaagagggccatcatcctccagaccccacaagggtggatccactgacagcttgcactgtgtgcctgcaaaagttgcaggcactcaatgccagcccattaaagcagctgtgggggctgtatcctgcagagccatggggcagagctgccaaaggccttaggaggccaccccttgcatcagcgtgccctggatgtgagacatggaatcaaaggatatgggagcttgaagatttcatgacttccctgttgggtttcagacttgcatggggcctgtagcccatttgttttggctatttctcccatttgcaacaggaacatttacccattccctgtactctcattgtaccttggaagaaactaacttgttttttattttacaggctcataggtggaatggacttgccttgtctcagataagactttggacttttcagttaatgctggaaggagttaagactttgggggactgttgggaaggcatgattgtgtcttgacatgtgagaataatatgagatttgggagaggctggggagaatgatatggtttggctctgtacccccatccaaatctcatgttgaattgtaattcccagtgttgggaggggacctggtaggaggtgattggatcgtgggagcaaatttccccttgctgctctcgtgatagtgagttctcacaagatctgatggtttaaaagtgtgtggcacattccccttcacatgctgtttctcctgtcactatgtgaagatgtgcttgcttcccctttgccttctaccatgactgtaagattcctgaggcctcccccgccatgcttcctgtacagcctgcagaactgagtcaattaaacattgcttctttataaact

SEQ ID NO: 191 - DNA, 1964 bp, Homo sapiens
acagaaagagaatagaagtctttcaaatttgtgggaaaattatctggaaattgaaagtcctccaggcaaaggtctggctgtgatattacttctgggcgacacttctcacaagagggaagataagtactgtcagaccacagatccctgttcctggggagaatgcaccagggaatacaagaaagtagtggtccacaacctttttggcaccagggactggtttcatggaagacaatttttccgtggaccgacggttggaggacaatggttggattctgcttcattagtagtcaatctcaatgaatctgttccacatattaccttcaaggttatttactttttcttctccaggacacagtgcttagaaaaatcaaatagaaaagccaccaagcttaccatttcaaccaaggataaatataagaacatcccagcagtgactgtgaagatccagtcttgaacacatggatcagctgacacggaaaggccaatgtataatcccatgaaggcagttagggagcttataaaattcatcaggatggcagtcttcatagaaagtccagagcttaagagcacggcaaagtctcctgaagtttaagaggaaaggaaaatataattatcatttaatggaagacgcctttgctaaagtaacgcactattagctatttcgaatgtcagcactggaaccaattttataggtagagttgagtgatcagtaaataaaatgctttcctatatttctctagaattcatagcccattcatcgtactattaggaagttgcatttcaagagttccattcctttggctgctcctaaagattgtatctacagagaggtctgtgacatattcttgagttcttgatatcctctgacatttccaacttagataaatggaaaatagtcactcactgtcccagggtttctaaatctttgggcctggaaatttgccaggtgaaatcatgacactatatgggcttttattatttacttatgcagaaactgctgtggggagagaaaactacttaatatgagatttttaaagcattgtaaaagttggttaggaaacaaatttttccctttagaaaatgattataggaaaatgatctcattctctccatgccttccctccaagagaagattgacctgttagtaaatctgagaacatctacttcttagtttgggggattgagactaaaattcaatagacagcttggggacccagttttctagttccattgcataattgttcccatgaacggggcttgaaacatctctgctggcctgctgcagacggtcacactgccctgtggctttgggttgaggactgggggctacatccctgttacagtagcaaaactcaggaccacagataggggatggcttccagaccaggtgcattttaatgagcccagggaggaccttggataaactgctccaagaaggataggtcaataatgagtcagtgtcaggactttgagcaacggactccaagcacaagagggcaagcgtttcctaggggcaatgtaggtgcgaaagtggaagcagagagactgcgaagagccctctcccttgggagcctatgccagaccagcctctactatttctgggtctgtttcagaaacgtctgttctaacccatcttgcgtcctgggaggcaaagaacagggctatattgttctcacttatttgtgggatctaaaaatcaaaacaattgaattcatggagttaaagaatagaagaaggttaccagaggctgggaagggtagtggggtggtaggggaaggtggaggtgaggtaaagatggttaatcactacaaaaaaaaaaaaaaatagaatgaataagacctagtatttgatagcacaacaggacgactacagtcatcataatttaatttgtacatttaaaaataactaaaagagtataattggatagtttgtaacacaaacaataaatgcttgaggggatggat

SEQ ID NO: 192 - DNA, 1566 bp, Homo sapiens
gttgtcagatgagttgctgtacacctcagctctatacacaaaaatgtgtaactgtacccagttcatacattaagatccagaaagatctaacgaaaagcattgtttggcagcctgacttggtccagattcaaaggtaagttttaaaaagctctaagaggaaattgaggtatttgtgatgcataggaattccattgagaataaaatttactattataattccttcattactcaatgttactgaaaatacttgaacgaaagtaacttgatttgtctacccaattttacgcattgatttacatttgctttcagcaattgacagtaatgttttataaatgaatcatttctgcaagtgacgttgcaataaatgttagctttccccttataatgacatttgtccttttcttctttgccatgggttttgattttttcccctattattgtctctttgggggttttatttttaagagattgcatgccaccagaatctgaacaacaataacaaaaacctagtaccttctggaagtagaatttactcttttgccgttggcaggcaaatacgccatgcgagacctggtcaaccggctccccggcggcaatggccccagtgtcttgtctgatgagtccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggtaagacgccagttgggtgtgtgatacagtctcttgaaaagccgcatttccaggcgcttggccagtggcctgggaagtagcctgtgcttgtattgagacagtcccccagcagcaaaccatgttccagtcattccctttcctactttggggattgttgccttttctgcttgtttaaagtaaaacaagcatgtacttgtttgtatgtatgtatgtatgtagttgtacggtgggcacaaataaaaagagggctgtatccaaataaatcatttctggctgctcactggcacagtccctttgctccgtcccctcctggctcgagcagtctctgtgttttccacatgcatcagaaccgtcagcccagtgtcactttgcaggggccacatcttctagactggctcatctcttaaattcaaaccagagaatggagatcaatttcatttacattttcatggagaagagtttgaataaatagcaaaaggtataatgtg

SEQ ID NO: 193 - DNA, 2609 bp, Homo sapiens
gtgttttaccagaagaaccttctctggtttatgttgactttaagatgtccttgattttttaattattttttattatttttttgagacagagtcttgctctgtggcccaggctggagtgtagtggcgtggtcttggctcactgcaacctccacctcccaggttcaagcgattctcctgccttagcctcccgagtagctgggattacagcctgaattggcatcaccaagaattaacacccgactgcccaaatccctgtcaggactgtgggttgccttgcagctggccttttctcccagaatctgaaggagttctacaagctgaggcttagcgatttggcataaaccttgaaagactcagcccttcaggataccatgaattctccctggacaagctgctgcctggaccactaaggaagcccagcaaaatgctcaggccatgtgtgccctttcgtgacaagtgccaagattgtggacaatatcacaagacattgacagctttaagaaactcaaaaactggtgctggaagattttcttctgctaacctcttggaattcactgaaccagctaattctcagattcaactactggcttttactttaataaatggcaaagcagatgaccgcaaaaggccacactgccctcccagtttcttccagaagactggtcttcatcctgcctcatgactcccatagactccagggtgcctccctctttttttttttgagacagagtctggctctgtcatccaggctggagtgcagtggcgcggtctcggctcactgcaacctctgcctcctgggttcgggcgattctcctgcctcagcctccgcagtagctgggactacaggcatgcaccaccatgcctagctaatttttttttttttgtatttttagtggagacgaggtttcaccatgttggccaggctagtttcaaactcctgaccttaggtgatctgcccacttcggcctcccaaggtgctgggattgcaggcatgagccaccgcgcctggccaatgcctccctcttttaccttcgtctgcaaaatcccaggcccccttccttttctttgagatgtccctcattaatgagcattctcttcatggcactagcttgaataaaaccatctccttaatcgtcaagtgaatttcgtctgtcacagtgccagcgacgaactctcataagggcagccagcacttcgcccctgactgtcctgctggagtgacaaccatctgtgctgagcctctttgcagtcctcctgtggctcatccctcggacagccgccctttcaacatctcaggcctgaccttgacctgagtatgtcttgccagaagatctgacatctgcgtccctctacgttgatgtcatggcagaatgcacacccgtattctggctttttccccaaggaacatgctggaggggtcaaaatggcagagctagccccctgccccgttctctgcacttttggaatccctgcagaatgggtgggagaccttgtctagggacggctgtggtaggcattggcttgcagctggtatctggttatgctggtggattttaagattgctcagtgataactgtttcatgatggagaatcttcttcaagtcagggtggtcttggctgactcctgttatttgggcttgtataacaaggttttaaccaagtggttgcctagaacctggttgtttgaaaattccaatcgttcaaagttaagtgcctactctaagtggccaagactaagttttcctggctcaaagtggtgtcaagctgcagtggccgttcctcagggacctctgatgccaagtttcatctctctaagccttaaagcctatttttatgtaattcatgtgcttggagatgactttgaacaggactggtcttttaaaaataagcagaagaacaaaagtcctctagcaatatcatggccctatatgcatggctgagaggttcccaagtcggcagacagctccatgtccaactacctaagtgaggatgaaaccaaagtcttccagttaggggggccaggagcagtggggtgtccagcaagggttgcaaggagcagtcaaggacctctgtggttatgctcttggcaccaatggggcaccctagaagcagggactcatctgtgctgtctgtccatactggtgtgtccctgagttcagaagactccctgacatcctgtaatctaatgtgacaagcattacagtaactcgcggttccacaggtagtcagatcctttctgccttaggtcttagggcagagggttgagtttggattcctggtggatgacatcattcttggtggttgggaggggaataggaaaggagcatctattaagcagaggaatgtgccgtggttcccttgcatgatttgcccatttgactggtgagtatgtgtgctggggggaggtgcacataggtgaatgtgtgggtgtgtgtgagtgggtatgatgtgtaaatgtgggggaggttcaatgagaggtggcccagaatacttgtataggaagcctactgaccaccccaggcagtgcctgctggctgggctggtcaggaagtcaagaagcggtagagccctatttacctggcatcttctgccctgttcatctacggatt

SEQ ID NO: 194 - DNA, 1783 bp, Homo sapiens
attaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaat

SEQ ID NO: 195 - DNA, 1974 bp, Homo sapiens
atatgatctcctgctgtcactccatcgccttccctcccagcaagcttgagatcctctcccccacatggaatctttgaacatcccacctcaaaactgtttcggatgctagaaatccatggcttagaagttccagccctccatgaaccgttgggttgaggttctctgggtcctggattaaggattctgcagctgcttcaggctgatgagtgatggctgccatcggccttagagaatgtggggcagcccaaagtatggcctcacactttgccgtcgttcaagttccaaactccttattctatagatgaagaagctgatgtggaaggaggggaaggcactgggccgaggagttaagaaagagcagcctgacatgtctcatgcacctcctgtgagctgcacgccagccaccgtgtctggaggaagctgatgtggaaggaggggaaagcactgtgacctccaggagccaatgcactggaccccagggtctcaaatagcaaaggccaacccaagaccagcgaggcccggcagctcaggaggcaggtgaaatggcgtggcaggaagccacaggaatctcacagaggggatgaatcatttcaggctggaagcatcctcttacagaagtttccttttcaccacttgagaggtagaacagagtaaattattagtagtgctggaaaagccagtcgccctcccatgtgagcaatgccgggaacttctcagagagctttcctatctgacattgttcgagacactgggatgccctaaaaaggtggacagtgaggctcagcctgtcctgtttcattaaggaagaaattggggctcagggagatgatctggcctgaggccacacagcccaacctccaggactcctggtttagcacctggtgccttgggtctctcttccctctggggctggaaaagcaggaccgggaactgttttttggcttgtcttccagagaaagagaatcattgtctcgccttctgtgttccactctcctcctcactggtgccttttgtccccgcctgctctgtgccagcattgagcctggggctttccacacaccatctcacgaacctcgcaaaagctacatgaagggggagcgctcattggcccattgtgcaggcaaggaaactaaggctcagagcagttgagggttcaatgccaagactggactccaaatgtctgctctttcctctcagctataagcctcttgccttcaagctctcctgcaccggttattaagccaaagcggcatctgctgtggccatgttttgcgggggagagaaagtcatcgctcagtctcctttgctgaaaatgggtgtaatgatcaaagtactcccttcctacagtccttgggtagactgagatcatggctaggaaacggagcctgacacatgagcagtcttattattttatcgcccttgctgccaccgctcctgttatgttgatctaacacaagacaaaaacagagtcttgagaatctcaacgtgctgtatccaaggcagggactgagggggttgggctgctgccacgaggactggggggaatcgagggctcaggggaggcaggaagatgaaggactgttaaggttttacgttttccagcaggatttagtgggagtggagcctgcagagggggtggcacagggctgggaccagcacggggctggattccaagcatcccaaaggccagaccccagtgcctgtgcctctgagcccgggtccagccctgccacccaggccccatctgcctgcattgccatctccttggcttgttaactcggtcagtccctgggattttatcaggcgcctctgaggtgcccatttctgggcagcagcattgcaggaagaggaaaggcctgtgacagagcagggcaccagctcaggtcccaacggggctgagttctagcccagctccctcacttccacgcatgggctcagaacacactggatccacaataaagcttttgatgaatg

SEQ ID NO: 196 - DNA, 2003 bp, Homo sapiens
tttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcatctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaaccgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttggaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgc

SEQ ID NO: 197 - DNA, 2170 bp, Homo sapiens
acacagcctgggggcatccgaatgcacgggagatgttttacactcagatgaaacaaactgtttagacctcggggaaaagagactgtgcttgaacaaagtgaaccaggagaaagcgccctcctgagacatgtctctgctttcatgtttgaattgcctgggattctgttctctaatttctgatccttataaactaaaactgcctaggaacattgagcatcctgactttgaaggagtctctgtggtgtttttgtgctaccatacatggggaataatgatgtgaggcagagggagagggaatgaatgggagagccaagagggaagagcgagccggggggaaaggagcgcgcagtgtttcctgctgcggttaggacctcacgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgctctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacacccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagc

SEQ ID NO: 198 - DNA, 1920 bp, Homo sapiens
ttgttgagctcttctcttcttggggggtgagggtgaggtggtgagaagaccccaggtcattgagcaagtggtgggaggcatgggagaacagagggaccaggccgggcgtggtggctcacgcctgtcatcccagcactttgggaggccgaggcgggtgggtcatctgaggtcaggagttcgagaccagcctggccaacatggtgaaaccccgtctctactaaaaatacaaaaattagccgggcatagtggcgcatgcctgcaatcccagctactcaggaggctgagacaggagaatcgcttgaacctgggaggtggaggttgcagtgagctgagattgcgccactgcactccagcctgggcaacagagtgagactccgtctccaaaaaaaaaaaaagaaaaagaaaaagaaaacaaacaaaaaaaaaaaccagagggaccaaagaactggggtcccagacaggaaaaaatctaaagagcaggaaggggacccctgtatctgcatcctggtctatctcctgggggaagttcttagaggccaatggagtgatcttggcctttcaagcagcaagctaggtccactagggaaaggtgacagaggtgtgaacagacagaccctctgtcctgctgaccacttgaccctggagaggggtgatatggaagatcggggcagtgggagctctctagcggctgctgacggctctgtctccctaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcggacactctcttcaccatgactcagtccagcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccacgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccggtaagatctcgggcactgggcggtggggctgtgcccacggccttcaacccgactctccgcccttctccaccccagcaggagacagtccctgaattcccctgcacattccttcccccgaccccggcccctacaccgccccggccacctccaggccc

SEQ ID NO: 199 - DNA, 2871 bp, Homo sapiens
gattgacactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacagaaaaccatgataaattctggacaaaatacagaaaacccacaactctctgaaggcactggagagtgaccatagcaggcataaactgaaaggaagtctatacttggaaagagggagtatcaccgaataaacgaaaatgaggttttgttgccagcagaccttcactgcaagaaatgctaaaggaaattcctcaggctgaaaggaaatgataccagatggaaacttggatctgaggaatggagaactccaggaatggatagaggttccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaaggtggagtcttctgatgcaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggccgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcagtgagtgaggacctgggtagaggaccacttttataagagagtgaactgcatctgcagacccaccatactcctgatcaagacagttgttgacctcaaactccagactgtcccctgctgatgacctcatcatgcttcttgtcagcaagcttggctctctttagtttggcaaggattaaaagacatacagtgcctatattcactgtattaagtaactggcctttaaggacatttgattatagtaccagcagaaattagtatgtactggagatggctatagacacttctgttacaaagctacagttgtattaaagctgtgggatgaggacagcctttaccaacatggtcaaaatcaaagatttttttttttctactatgtagtgaagggcatacatagtatgtgcaaactgcagctattaagagagatatgatgatttttggctgtttacattcatgaatactttataaaatccaggaaaaattttgttagatattctactctattgaagtctgaaaagaaacatgcagagaaaatataatcaagaatttatttggcagatttataacatctgcagagctcagagctcaaggaaagaccataacacataaaatatgagcatcaataaatgttcagaatgtg

SEQ ID NO: 200 - DNA, 2118 bp, Homo sapiens
gattcttgggttccgcgcgtagtttcggaaggagacatcgaagcagggcgaggcgcagagggcgttgcggactcatgccccagtcggcagtgcggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcagtggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcctgcccttgtgccccacaacctggccaacagtactggaagaaactggacacagtcaccagcatcccaggggagggcaaaacagccatgtcgtgccctgatgaagagcaattctgatcacagctgttactcactgagcaccagccaggcaccaggcaccccataacacggcttcctgtgctctccttccagagcctgtcgcagctctaggggggagctatacaatgatgtctttattagtgtcatcatgagaagcccaataagcagtatgccctaacagttagtaggccaggctctggagctaagctgcatgggttcacatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtataaatgggctacttgtcataagccctaagtcacaggtcaacaaactgagaggtaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcacattttaggtagaggagacagcctggacaaaggtctgagggaggaaggaacacaaggagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctg

SEQ ID NO: 201 - DNA, 2349 bp, Homo sapiens
ccccgcccccccgcgcccgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttctacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagatc

SEQ ID NO: 202 - DNA, 2379 bp, Homo sapiens
gatgctccaaatatccctacaaagtactttattattcctgtttcacagacaaggaaactggggcacagacaggttgaacaatgttcctgtagctgagccaggatttgaacccagggatttatttctctacaagggacacaggtgactgaacttcctcctggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccgctgggcggaggtactgcccgtagatcgcatgcccaccctctagaacccttgcctccagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccgggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcagactgagtacgagaggagtgtgaaaagaatcgaagaagggagtgctgacctgagaaaacgaatgtcccggttagaagaagaactggaccaggaaaagaaaaaatacatcatgctggaaataaagctgcggaactctgaacgggcgcgggaggatgcggagaggaggaaccagctgttgcagagggaaatggaggagtttttttcgaccctaggaagcttgactgttggggcaaaaggtgccagggccccaaagtaaaaggaatggcagagctcacttctgtaccacgtctgctggtctccagccttgtatggagttagaagcgtctgtatctctggagcagccaggcgctctggagccagctggagagagagagatcctgatacctctgtggggactgtggggacttttgggaccccacacactccaggtgggatcagatgctgctccaaccatgcagttcctggtgagggtcagaaggggacggtaccaagagcagcgcttagcccttacccaggaaatatccttcatggccacagaaatggagggcgcccaggatccaggcagccaccgggaacagtcagctttctttattaaatgtgctcacaaagc

SEQ ID NO: 203 - DNA, 2954 bp, Homo sapiens
acacagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacaaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaactttgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtacatcgggtcctcccatgtgtggtgttcttctggaggttgtctctttggccaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaag

SEQ ID NO: 204 - DNA, 1700 bp, Homo sapiens
gtctgcgccggccagcgcttggcccctcccgggccgcagtactcctcgtgtgacacggacatcattaagccagctgagaatcgtgcggttacagctgctgcagtttctttgcagacactggcttctctggactttgcacacctccaggagaagaacccagaaaattgatcagttctaaaaaaccatgccccacttgttggtgactttcagggatgtggccattgacttctctcaggaggaatgggaatgcctggaccctgctcagagggacttgtacagggatgtgatgttggagaactacagcaacctgatctcattggagccagcccgtacccgcgaagagcaacacaatctgccggtcccaaaagcaggaagtgtcaaccttgcagcaggatttggacactccaggagccaaactggatgtggaagctccaaaggtgcagaaaaaggactccaaaatgttgacttttacctctgtcctgggaatcaccctgacactagctgtcgagatacttaccagtttttctgccctgattggacatgtgtaactttagccacctactctgggggatcaaccagatcttcattccataactcgtgcttctcgtcctaaattatgtactagaaaaaattgtaatcctcttactataactgtccatgaccctaattcaactcggtagtattatggcatgtcatgggaattaagattttatatcccaggatttgatgttgggactatgttcaccatccaaaaaatcctggtctcatggagcccacccaagccaatcgggcctttaactgatctaggtgaccctatgttccagaaaccccctaacaaagttgatttaactgttcctccaccattcttagtcataaaagatacactccaaaagttcgagaaaatctagataggcgccaacaggaacgagaaaacaacatcccctggtatcaaagcatgttcaactggaacccctggctaactactttaatcactgggttagctggacctctcctcatcatactattaagtttaatttttgggccttgtatataaaattggtttcttaattttgtaaaagaatgcatagcttctgtcaaacttatgtatcttaatactcaatataacccccttgttataattgaggaatcaacgatttgattccccaaaaacacaagtggggaatgtaatgcccaaccttgtttttactaaccctgtttttagactctcccttttcctttaattacccagccttgtttccacctgaattgactctcccttagctaagagagccagacagactccatcttggctctttcactggcagccgcttcctcaaggacttaacttgtgcaagctgactcccagcacatccaagaatgcaattaactgataagatactgtggcaagctatatctgcaattcccaggaattcatctgattgataatgcccaaagcccccggtctatcaccttgtaatagttttaaagcccctgcacctggaactgtttaatttcctgtaaccatttatccttttaactttttgcctactttatttctgtagaactgttttaactagaccctcccctcccctttttaaaccaaagtataaaagaaaatctagccccttcttcgggccgagagaattttgagcgttagccgtctctcggtcgccagctaataaatggactcttaattcgtc

SEQ ID NO: 205 - DNA, 2296 bp, Homo sapiens
caagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcacccgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggggggagagagagaaagagagagaaagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctc

SEQ ID NO: 206 - DNA, 2291 bp, Homo sapiens
agtcttcaggccccaggtcagtgagtggcaagccaggcccagagatctctgcgcccgttggaacatccccttctcgggaggctggaaggccatggtcattcacctctccccagcaaggtgggacctgccctggaagaagaaaccagaccaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcaactcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctgatgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcaccgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgttt

SEQ ID NO: 207 - DNA, 2499 bp, Homo sapiens
cttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaacacaatgactatcattactgatgcagacctggctgtggagagcagctaatgtgtggcccagagagcctgtctgtgtggagcacgtagtgcacagaatacgtgagagttgctctggcaggggcagaatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggatcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagc

SEQ ID NO: 208 - DNA, 3086 bp, Homo sapiens
atacctagctccaagatcttggttgctaacaccattctccaataaaacgaaccagggatcgctggagaaatagctgattctaaaactagggcagaaagtatacaagatgagcctggagcatcttgtagagtcagagagcaaggcagaactttatgcatacagtgatgtgagatgggcatgcagagggaagatgttcccagtggctgaagctgaaacagtgtgagcaacaaaataaagcagtgttggatcacaacccaaagaataaaataaatatcctcgagcccacaccgatataaataaatgattgaatcaataaatgagtccaggcactgtggctcatgcctgtaatcctgcactttgggaggccaaggcgggtggatcacttgaggtcaggagttcgagaccagcctggccaacatggtgaaaccccgtctctactaaaaatacaaaaattagccaggcatggtggtacatgcctataatcccagctactcaggaggtgaggcaggagaatcacttgaacccgggaggcagaaattgcaatgagccaagattgcaggactgcactccagcctaggcgacagagtgagactccatctcaaaaaaaaaaaaaaaaaaggatggacaagacaaatctcttgtaaaaaaaattacaagtaatttttatagaagctctgccctgagggagggggagcgtgacttctcactccttcagtgtgggctgcacaagtgacttccttccatatgggatcgttataacaaaagactgtaacaagggctatgggagttataagacaggaattgtggacaaaaaccagtgtatatcataacatcacaccttgtaatgttggcagtacagtcactgacctttgataaatgttgatgacatgttgagtaaaggaatgagagaaagaggattgtttatctctgtttttatccttctcagagaaacttagagtaacaagtgtgttatcagccatgctgatgcctttggtaaactattgtgtgaatatggttgttttgaattggtcagtagaaactgggctgccaggcgcagccggtaagcatttccatgtgagccttaggggagaagtgcatttggtaggagcatcaaaatagcttctgatatttcattaaaagtttgggtccgtctggttccttcattagtatatgtcacttcctttgaccttcagtgtctgttgaaccatgtgattttagaaagcaagggattgcttgacatctccaggctgtgaagactaaagttcacaggaaaagactacaaggaaatttaaacagttttattattttccccctcatttcttaattttcctgccactactcagtactgtgtgggtccaggatcaccattagggaagacagagtagctcagaaatcagtagtgaggaggaggacagcactttgtgtggtatcttgctctaggagcattttcaagccatcagaagtgggactcttgaagactatttctgactttctcagcacaaattaagataataggagatggaggctccatttgaaaaacattttggttgtataatggttagcataaaacatacttttttcaagttaactcaggtactagagtatggggggcggggggaaatgtactgcagcattaatgaaaactagagctgggagaatgtgtttttccttgagtaaattgcaaatgcctgtgcaccgcatttgaccaggagggaagaatgagaggccctggtagcaaagccagtggaagaagttttactaggagcagttgtatcattcgtgtactttttttgtgtcatacaagtgagagtaaaatggtccatgtctgtgttttgaggaattttttgcctttcttttcagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagaggcagtgtctggcttgtaaacaatggaagggaatatttaactctaaacagaaatctgttctgacattaaaaggaaatgagtgagaacatttgtgcaggtactaatttggtcgaagcagataaccaagcggagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggacctgtgaggtatttggggcttcagtgctcgttgttggcagccttcagtgtatcagcgacaaacagtttcagcacctcagtgtctctgcagaacagtggcttcctctagtggaggtaagaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaat

SEQ ID NO: 209 - DNA, 2358 bp, Homo sapiens
ccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcggaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccc

SEQ ID NO: 210 - DNA, 2455 bp, Homo sapiens
cttaaaagtccaaaatgatctcctttgactccacatctcacatccagggcacgctgatgcaaggggttggctcccacagcttttggcagttcctccattggctgacgtttagtgcctgttgctcttcaaagtgcacaatgcaagctgtcaatggatctaccaatctagggtgtgatgatggtttccctcttctcacagctccactaaccagtgccccagtggggactctgtgtgggggctccaaccccacatttttcttccgcactgccctagcagaggttctgcatgaagtttccacttctgcagcaagcttcttcctggacatccagacatttccacatatcctctgaaatctaggtggaggttcccaaacttcaattttttacttctgtgcaccctcaaacccagcactacatggaacccgcctgggcttggggcttgcaccctctgaagcaacagcccaagctgcaacttgggcccctgtagcactaatggagctggagaagctgggacacatggcaccatgtcccaaggctgcacagagcagggggacccttggcccagcccaggaaaccatttttccctcctaggcctctgggcttataatggcaggggctgccatgaagatctctgacatggtgctgagacgttttccccattgtcttggctattaccatgtgctcctcattacttatgcagatttcttcagctggcttgaatttctccccagaaaatgggtttttcttttcaactacatagtaaggctgccaattttccaaacttttatgctgttcttctcttttaattgtaagttccaatttcaaatattctctttgtgaatgcatataactgaacactttcagaataatccaggtcatgtcttgaatacatcgctttttagaaatttcttccaccagaaacccataatcatctctctcaagtttaaagttccacagatctctagggcaagggcaaaatgcctccaatctttttgctaaactgtagcgagagtgacctttgcttcagttgccaagaagttcctcatctccatctgagaccacctcatcctggacttcattatccgtatcactctcagcattttggtcaaaaccattcgacaactgtctaggaagttccaaactttcccacatcttcctgtcttccaagccttccaaagtgttccaacttctgcccattacccagttccaaagtaccttccacattctcaggtatctcatagcaatgccccactaccctcagtaccagttttttgaattagtccgttttcacactgctataaagaacttccctgagactgggtaacttataaaggaaagaggtttaattgacttatagttctgcatggctggggaagcctcaggaatcttacagtcatggtgtgagcggaagcaggaatgccttacatggcagcagtcgagagagagtgtgtgaaggaggaactgtcaaacacataaacccatcagatctcatgagatctcactcactatcatgagaacagcatgggggacactgcccccatgattcaatcaactcccactaggtccctccctctacatatggggattatggggattacaattccagatgagattttggtggggacacagaaccaaaccatatcagtatgtttaccagtttgccctagcctctggcttcagaaaatagaaagggcatcttttcatgtgttttttgccttcattttctgtttttcctcttactctgtaagaaagagtctgtttttgttttcttttctgtgctatctgctctactgtttgaggaaggagggtcttgatgagttgtcacctttctgtgaacagagcttatattttgagtgtggcttcactttttatcttagaaataaagcagaaagcagggtgttctaatcagtcgcacttcggtctcaaatactacttccatgtaagtcaaatattaatagtgaagagaatgagccaactttctaaatcgaggctgtatttccatctctatggggtccaaaataaaactggttaaaaaaatgccatcttcactatgaaagactcactgtctacaccatccctcttcccatggagtttctgttgacagagatggagtcagtcatgtctcatgggaagcggacttgggcagaaggttcccctgcaaatgatgctcgatccccacaaagatgcagcagagaaaggcagaaaacccagtcttcagtgcaaaatggtgaggaggagcctggcttagaatctcagcctgaaatgacaagtgaaaaaaagtctctgaatacatttgttgaggctagatggtgttacccacccttgctgtttcactcctctgaagtgttctctctatattttgctattttgcaagggaggggaagaaataatatgtatgcttatctgtgtggattttaaacaagttgctgaattatcaataaagttttaaagtgctc

SEQ ID NO: 211 - DNA, 2501 bp, Homo sapiens
gacctagcgtgtgctcagctctggacaagacatggatgtaggcagacatgcttcctgcctgctgggcttagtgcaccaatgctaaggacagacatgaagggcttgggaaaggcatgaagatgcagggagtctaggagagaggataagaaaaacaagcattttgtggtgggttgaattacgttgtcgtttttagaggcatttcgtgatccatggttgcgctcccgtgaagagcgagtctagagaaggaatccgaagcggcggcggcgagcgcggctcaggttgatttagaatacgggtgacggtggcctggcgcgagcccactgctgacgaaagcggcttatcccgcgcggtttccatggagacgagccggagccgcggcggcggcggggctgtcagcgagcgcggcggagctggcgcgtccgtgggggtctgcaggaggaaggcggaggccggggccgggaccgggaccctcgcggcagacatggacttgcattgtgactgtgccgccgaaacgccggccgccgagccgccgtcggggaagattaataaagctgccttcaaattattcaagaagaggaaatcgggtggcaccatgcccagcatttttggggtcaaaaacaaaggggacgggaaaagctcgggtccgacggggctggtgaggagcaggacccacgacggacttgccgaggtgctggtgctggagagcggcagggaggaggagccgcgcggcgggggcgacagcggcgggggcggcggggggcggccgaacccggggccccccagagccgcagggcccggcgggggctccctcgccagcagctcggtggccaagtcgcacagcttcttctcgctgctgaagaagaacgggcgctcggaaaacggcaagggagagcctgtggacgcgagcaaggccggcggcaaacaaaagcgggggctgcgggggctgttcagcggcatgcgctggcacaggaaagacaagcgggccaaggcggaggccgcggaggggcgcgcgcccgggggcggcttgatcctacccggctcgctcaccgccagcctggagtgcgtcaaggaggagacgcccagagccgcgcgcgagccggaggagcccagccaggacgccccgcgagacccagcaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacgtgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagcccaagcacccggagaaggagcagcaggaaggcgtccccaacagcgacgagggctactgggactccaccacgccaggcccagaggaagacagctcgagcagcgggaagaaggcgggcatcccccgggatagctacagcggggacgcgctctatgatctctatgctgacccggacggaagtccagcaacccttcctggagggaaggacaacgaggagacgtcctccctgtcccggttaaagcccgtatctccaggcaccatcacctgtccactgcgaacaccaggcagcttgctgaaggactctaagatccctattagcatcaagcacctgaccaaccttccatctagccatcccgtggtgcaccagcaaccctccaggagtgagatgcccagaacaaaaatcccggtttccaaagtgctggtccgcagagtcagcaaccggggcttggctgggaccaccatcagagcaacggcctgccacgacagtgccaaaaagttgtgaggtcttccaggccaaggtggatgggccccatgccaaggaatacaacttttccctggaaaccactaaagtaagttttgcttttcctaaagaaagtcttttaggacaccacccgtcccccgccctgctccagagcgtggaccgaggaggtctttgtgccctgagcagggaccggataacaccagaaagagggatgctacacgggggtttctcctctcaagataagtccctgagaattattttcaagcacttttttcttttttacctttaagtttttcttccttttgctttaatatactgaacacttggaagtcacctttacttgcctttgcagaaaacagaacttagtcaaacctaagtaagagtcatgcctggatattgggataagccagtgtttagaggcctgaaggaaccgctgaagaaccagaggagatttccttttccaagacacgtttccttccttcccttctttcctctttcctttccagtt

SEQ ID NO: 212 - DNA, 3412 bp, Homo sapiens
cttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttaggacatttagggagcctccagggtccctacagtttcatctgatcccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatcccttcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 213 - DNA, 2467 bp, Homo sapiens
aggacactgccttctcagcggcttcagttatcagatattcctggacatactttccaagccatgaaaaataaccagagccacagctttcccagcactctgacaaacatccatgagcccccaaagaccgggaagtaatgatgatgcagctgcggcaccatagaagaaacaagtgatttcagtcaaagggcctggactcacgagctagcaactttggacagattcttgaactctcagcctcagtttctgcttctgtaaagggagataactacagtgaccttcaggttatcttgaagatgccaatgagctagtgaaaatgcaatttaatctgtacagaactaaacaaattaggctgagatacctattgctgtggtcagcaacaccatggaggcttcactgtgggacttcagatttgttggtgaagagaaagctatgggggtcccactctccctcccagcttgaggtctctgagatgcaacacaaggagccttggaatgaatttctccacagccagagctctaaatctggaagaagcccaagactactgctggagctcacagaatggtcatccctggagcagcagccatctcccctacatcctacctgcctccccatcatacttagaaggcaaacctccttccccttggagcctggaaggggagcggtggctgaggaaccagaggaaagcaaggtggcttcatgacagaggtcaaggggactatgttagatagggctttttatggcaagtgacagaaatccagcttaaattatcttaaggaaaagaggaaaatgtactggctcaagtaaccaggctgagggaagggcaggtggccaccagggtcctgggacagtgcaacgaggacttggaacccaccaggccctttctgtctcttgtctcttctctctaaggctcagtttaattctcctgcagattggtgccttccttgcagtataaaaacatggctgccagctgctctcatgagcacctcttcccagcttcatgattaagaaggaatgctcttccttccattccagttagtaaagtcctagacaagaaagccaaatggcccagtcctgtgggcaaaaaggtgaagcactataaaagacagttcccattaacatcaagtggaggaagaggaagagtagctgcccatgaaggattctcagaaggagggctgggtgcccagcaggcaacagcacagatgtccaccagataaggatcttccagtcctgggcccccaagcctctgcagtatggtgggagctgccccgggtgagcagcaggggaaaagaaacagggatgagacagcagggctggagttgctgaaatcctggcaaaattcgatttgtggtcagaatgaaacatgccttcataactcaggtcttcaatgctttggggaactcatgtggcttgggaggctgaaggcacacaagaaaggagggcaaggggatcagagacaccccacaattccagaaaccaccctgggcttcaaatgcaaatgttgctgacatgcagaaggagtggggttgtaaacataagggttggaaaaaaaaaagaacgcagtctggttgcagtatttccacctgagccctgcagagctgttctgccagacagtctacaaagcatgcacctgggtctgcaagtgctgggtgtgcgcttctatttaataaataaccctggcacactgtataaacatcagatgaacatgaaagctgcaacatctggagaactgtcaccatctgccactctgaggggagcatttaaagaatcagcgggataggagcggtatgtggcctgagttaaaaaaaaatgttggcagctgctgccagctatcagttgctgcgaatagcagtggttcttcctgacgtggcagtttatggactttcacaaatcccgggtgacccctcacaaaggcggaggccaacatactaaccggctccaatagccatcactcaccaagtgcgtttacaaggctttgttcctgtctcttttgtggcctcacaatggcagatgcacaccaggtcccacaaccagagaaaaagagagggaggttactcgtggagatgtcagaaaaagtactccccttgtgcctgacttctttgattaaacccttgtttgattttgtccagagaggcaagacttcaacatgtagctctaagtgctgggccaggcaccccaggtttagatgaaaaactaacgctgatagaggtatgtgtttacatcagaccgaggttatacttacatttttcatttgttaatataaatctaagttaaccacctcaagtgggactcagcaagggctgctctttattaatgggctggtcgttgctgtttttaagagagtgtcattaaccctaacatacgggctccttgtgtaattgaacagtaaatgtgattatgatcccaactgccatctccaggcacttcttggaacacaagttctttgtacaggagaaataaagtcagacac

SEQ ID NO: 214 - DNA, 2404 bp, Homo sapiens
taaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtcggaaagaggccggggcggctgggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagactcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcggatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattgggtgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctc

SEQ ID NO: 215 - DNA, 2636 bp, Homo sapiens
aaaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggacagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcagggctattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggggtaaaatcaactgcaactttttgatgttaatttttttccctgtgcaattataaactataagcaagttaagtgacaagcaaatgtaataaagactagtttt

SEQ ID NO: 216 - DNA, 2137 bp, Homo sapiens
atcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttttgcccaaggccacagccatcccactctctgcttccttgagattcaaaccaaaggctgtttttctatgttt

SEQ ID NO: 217 - DNA, 2275 bp, Homo sapiens
ggatttgctcccgacccgcttttggggcgtgcctgcttcctcctctctgttaggtgagtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagaggcattggacgtggccagggtcaatagtgtgaagccagaattagaattgaattgaaatgccttcggttttgatatctctgctgtttgtcttgaggcaactgcttttcctcctttgggcctctcagttttccatctagtaagtgaggaagttgaaccttatcggtgaatctcgtgttttcaggcgtagactcctttgagaatctggtgagaactgtagatcctcttgccaaagaaatgcacctacacaccaaattttgcaaaaagatttaggcagttcaccaaaggagatgaattttaggattctttacatttttctgattctgaatgttgctcagatggtaggcgggaaaaggtgatctgtgcaactgctgccacccgctccatcaccaggactggttctgctgatctagctgtgcctctcctcgcctgccaatctccagctccacgtctgcactgctcaaagcttcgtgagaacagatgattttgcgcaattgagttggatggcgttgattgtggcccacccctagagtgagggtttttccctgaaccaaaactggccccatccaccgtcattccccaataccttagttgtagtcaactaactagataggctgccgaagatggtttaactgtgtccagcttaactacagccaggctttggaatgcctggcctatgtctgtaaatgaaatctaacaatttattgtataacgttgttaaacatgaagcatgatgttggccctggataaaacattttaaattctcgtcgttcataccagaggctcagtaactgaccggttgaaagaaaactgttcattgtaacctaatgatgctagttagatagcattagattatgttagagatcagataacttgttctagctgcctttgccctgtctcacagtgctagtaagtcaggatttaaactgcccttctcaacatctcttggacaagaaaaagcgggaaatatgatgtatttattttctcagaccttgccaagtgaaatgtatcaaaaccaaacatgtctttttaagctgccacttcaaaatataacttaagataaaatctcatatatccttgagaaggcctggcacggtagctcatgcctataatcccagcactttgggaggccgaggcgggtggatcacttgaggtcaggagtttgagaccagcctggccaacatggcgaaaccctgtctctactaaaaatatgaaaaattggctgggcatggtggcgcatgcacctataatcccagctacccgggaggctgaggcaggagaatctctgaagccgggaggcggaggttgcggtgagccgagattgcgccactgcactccagcctgggccaacagagcaaaactgtctcaaaaaaaaaaaaaaaaaatctcatatatccttgaggggaaagaattgtctggatcgtgattgaattcccagggcttagcacacttcctggggattagtagatgctcaatacagttttggtgaattctcattttacctgctttccatccctaattatattaaataccaaaaactaaaaagttacagtatttcattttatgtaagcacatctccatcataaagagttagatgctttccaagaatgtgactcattactcggggagtacttggaaggtgggaacctcttgtgaatgctgaagcctgttaactcacacacctgacgtggcctgaagttttaagtcattatacataggactggctcacggtgtgatacatcatgacttggaaagagatagaaaagctacaaaatgggatggatctgagtgaacaaaaagccagatcggtgtcctataccagcaattccaagtctttttaaccatgggaaaaaaacctgaatttgtgtgtggactttatattgaagaaatcaactttgtattaatgcacatggtaatgccatttaattaaaaagctgtggtagatgt

SEQ ID NO: 218 - DNA, 2291 bp, Homo sapiens
cagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatggtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggg

SEQ ID NO: 219 - DNA, 2393 bp, Homo sapiens
actttctagctgaacactcagcttcatccactccaggacagctgagcgtctggatggtgtctcaccctgttgcccaggctggaatacagtggcacgatcctggctcactgcaatctccatctcccgggttcaagcgattctcctgcctcagcctctcaagtagctgggattacagggcttcagaagctgatggcatagttatgagaggggtgaagactgcgactgcatttccaacagaccctgaggacaattgggaagaatgcgctgaatatttttgagcaatttctatatgataagcagtttttagggcaagtataggttgcactgatcctgaccttttggcctgaggatggaagtcttcagtatctgtacaactttactcccaagagctggtgtagaatgagttcctctggccatgggaggatcgcagaggggcacctgccaccagcagcccagcctcagcacttttctcttcagcgtcttcttcaaggtatttccagttgcccgccctgaactgtttcagaatgaggaggacacctggaggaatctacacgtgcatagaccaatttgcaaaagaacctgtgagccaacattattacctcagctggaagaattaataagcaacacgttcacccaagaagtatttactgagcacctactatgtgcattattttctggtgttggggctagggggcaaacgactctgacaagtctctgttctcaaggctggagtgcagcggcgcgatctcggctcactgcaagctccgcctcccgggttcacgccattctcctgcctcagcctcccgagtagctgggactacaggcgcccgcaaccacgcccggctaatttttttgtatttttagtagagatggggtttcaccatgttagtcaggatggtctcgatttcctgaccttgtgatccgcccgcccccgcctcccaaagtgctgggattacaggcgtgagccaccgcgcccggccgtagtttacattttctaaagcgtactctgccagccaagtggcaaacagacttgggcctcttaagagtggaagcaggaggaaacccgaagatcctggagagagactggtggctggtaccagtggagagggagcaaaaaggaaaatacaggatacaatttcaggaaaaatttcataccaatttcctgaggtaatttctgaactcgaacattttcagtgtcaccacattgtgtttcctgctgaatcaagtctacatcacttcggtttttaaagccttccacgatccttccctgaacactgtagttttcactgatggttggctgtttcaaactcccatgtgatccatactgtatcattaataagcaagcaaggaataacacaccctctgctattctgtgcagtgtttcaggtttttagttttctctttcaagatagaaaatccctttagagtaggaactcggctggcactttctttcacatcctgcatagcacttagcaaagttctgtacacagggcacatgtggaaattgcttattgattgattaaaagcatatatcactggcatttgtatcttcagtatttctcttgtatgaagaagggtgattatctgtcaatattcattgcatcattgaaccaatgtacaatgcattaatcatcactgaagataaccagatgaggctttattgtaatctccttctattttgctgagataatttcacttgctttagagtttatgaggccataagtggctcccatctgttgatgaacatatttctaagagtcatttagtctcaagtatggaatacttgaggggaagttaaattgtaacttttatattaagtgtcatcttagtaacagaaccaaaattggaagcatgtgttcaattttggtttttcattttcaaagctttaggtcaggcaaagaattaatttcatttgtttacaaagtagattatgcctaataaaatctattttgtttatggtcacattttaatcaatccactgctttagaaaatgagagaattctgattggctagtcattcaacatagtaaattacattattccacatccacagaacactggcctaactgcattatccagtaatgataaaaatattccttttaatacattttgagcaaggcatataccagtggtgaaacagggaagaatcttgtttattccatccttgtttgatgatcgaccacagaatataacataacacttctgtgtataagaattttttcaacattaaggataataaggacaaggtagttttcactggatccttactggtactctgaattttcactatttgtccgcatttcttctccttcccggaaatttgttttctgcgaaaaacaagtgctactttgtcaaataaagcttaaataaaattggtttcaatttatgcataat

SEQ ID NO: 220 - DNA, 2602 bp, Homo sapiens
aacgccagctgactcgatttcgtctcggtcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagactgggaaactaagcctgagattcacgatgcttcagataaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagacctttttttgaccactcatccctcgcccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttacagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagagcatttgttttgatggctgttagtccccctctcttggagcattttggggcactaatcttgttctcttgtgtcccagcttttagacctcttacttccactgctagtagctagcacttactgagcacctgcaatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtg

SEQ ID NO: 221 - DNA, 2444 bp, Homo sapiens
ctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggagcttcagtctgtgatgctgatgctgcaccatggacctctcaggaagccctgatccccatcatatttgagggcacctctccctcttttactaaaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctattttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctcggaaatattcattaaaaccattgaaataaaaataaattcaag

SEQ ID NO: 222 - DNA, 3196 bp, Homo sapiens
agatattcatgaaccgttgcttcttccagcctcgccttctcgctccctctgcctttctggcgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtgagagagccatgtaatcatgccaacatcctgaccaagcccgatccaagaaccttctggactaatgatgatccagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagcgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttac

SEQ ID NO: 223 - DNA, 2014 bp, Homo sapiens
ctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttacggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacatttgtcatgtcagccagccagctccgtgggtgagagtgtgcgtgtgcgcgtgtctgtgtgtatgtgcgtctgtgtgtgcgtgtctgtgtgtgtgcacgtctgtgcgtctgtgtgcgcgtctgtgcatgtgtgtgtctgtgcgtgtgtgcgtctgtgtgtgcgtctgtgcgcgtgtgtgtgcgcgtctgtgtgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctgaaatggcaaaggtttttcgtgtttgtttgttttgtttctttgaaaaaagaaaaggaaaggaaaatcatgcagaatcgcaagcattcagactggacgaccggctcgtattccgatcagtcgcttccattgttagcatcgtacacgatcgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagcttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggctccaagcgtgctcagagccgtttcagacagtggaaatccatgacaaacaaaaggatgtgatcattaattgtaaagcgctttgtaaaattcacatttacaaaataataaagtcagttcaaacct

SEQ ID NO: 224 - DNA, 2965 bp, Homo sapiens
ctgaagcttcaaggtttgggttcagctctctcagggccaacagggtccttcatgacctctaccttcccctccagccaccctgtacctctttcaatgaacctggatttatgccatcctgaggtatattagattcccaaatgcttgctgttcctgactccaagcaaaattgctcttcccctcctagataaatggtcaccatccatctggtgctcaggtaaaaatcctgagagtcatccttgattcctcttcccttcacccatgacatcaaacccttttgtggataaggttgactctgccttcagaatatgatcccaaactgccatctcctgtccacgctcacagcttctacctccacccaggccaccaaggcttcccactgggtctgccacaatacctgaccaactggtctacctacccactgccaccccttacaaactattcttcaggtcctcagcagagcccacagtgctacatcatctggctcctgcttacctctgtggccacatgaccccttcccatggtctccctcccgcactgccttcttctggtcctcgtcgacaccaagcttgtctctgcctaaaagccttgctgttccctctccccaaaatgcacttccccgggctttgcatgactgatgcagggggcagcatggaaggtgatttctctgagatggactccctggctacctttacgcccccatgccctcgcatcacattattccttcctgtaggctttgcgacacatcaccatttgaaagcctcttctttgtggattcatttgtttacttgctcactctctgttcccctagaatataagctctctaaaggcagagactttctctgtcttcttcactgtgtccttgggaaacttgggaacttgtgcctggaacccagtaggagctcaatatatgtgctgaatgaatgaatgaatgaatgaatgaagtgaatgaacaaatgactgttctacttgtctgacttgtattcttctcacctggccccctttacctgcctaactccttcatgtccttcaagttcaggtctgctgatcatctctctctctccctctgctctctctctctctcacacacacacacatacacacgaacacacacacacacacaaacacacacacacagttagttgcccctctcctctatctcccacaataacacccagcatttactgctcactgtatgtaacactttgcattatggttatggtccctcccccaagctctgagctccctggggatggggctacatccttccactctgcatctccatcaccagctcacagcctgcccagggaaggcactgggtgactgcctattgagtgaatgaatgaatgaatgaacggtgaatgaacgaatgaaggaagaatgaacatattcttcaccagtagttaaggcttcggttattccttaagatataaaatcagatccgtcttacccaactcactcaatcagtctccaagtttgggattttgaagagcatcctaattccctcccaatgttcccctaagtccttattcttgccgtaacaagcaaacacttctctgaatcattttggaactggagcctccctcaacattgtatttctgattggttgctatctgttttgacagttgtcagtttttttttatttatgccaagctctccctggggtttagttccctgaatcctctcaatctagtgcctagaaagaagagaaaatgacttacctctaaatcttttttattgaaggtgcaccataaaacagatcctctttcacctctccactctctcctgagatttaaggattcttggcttttattgttgtctttacccctcatttcaaaagaaaaaagcagtgggggttggaggggcttattatatccacctagaaggaacagcaggattcacactttcctgccagtgaacccaaacaatcagagctttctaggggagttcttgacagtttcatgccagaaacacacaccaagctgaggacatttattatatggcacacatccatggaaccgaaattacagaccattttctcctacctgtcccttccatttgatttctgggaaatgtccacggataaaaccaccaatttccactaggaaagcagaaccctaaatataaataagaggggacttctggggctcctacggagagaaactttcccttgctcgttataactagtgtttgcacacatcgtgcagagcagaggcatttgcaggaaaagaatatttcagaaactcaaatgaacattccttcctccagttacccttactccctctctaatatccatctgggcaagggtgttgattaaggtcaatgcaaagtggctttatgttttgctctattttgtctctgcatatgctagtcactgtgtacctttcaaaaacatctcgtccccaactatctattcctttttataaatagcacacattattctctgattgtataagcaaaacatgcttattataaaaacttgagtacatacagaaaagtatatagaagacttaaaataattcataacgttctcgcctagaaataatcattggtaacattttagaagaaatactgaaagttatttgccttttttctgtgaatgtacatatatgtatattattaggattcagttcatattgtatgcacaattttctcttttttcttaacatcatatcaaaatgtttgcaagtccttaatctttgaaacatgactttgaaaacataatcatattttgttagccttaaaatccatcctagataaaataaaaccaaagaagttatcaggtgacaacagttaccctgaagtaaacaagtgagtctaaaattcgaaaatcagagtcaattgctgggcatggtggcgcacgcctgtagtcccggctacttgggaggctgaggcgggaggatggcttgagcccgggagttcgaggctgcagtgaactatgatggtgccactgcactccagtttcttt

SEQ ID NO: 225 - DNA, 2557 bp, Homo sapiens
ttgtacatttttcccaggccacacgatcacccacttagatcaatgtcactccaaactggaggctgtcagtgagtgttctcaggcctctcctcaccccaccaacttcctcagcacctccatccatacagtgtggagagcagaggagtgggttgggatttatgctgcattgctccagcgtctttcatctcttccccttgtcatcatttttgaaagtttgtggtttctggggttaaggaaggttgagtttgtggaagtccgtgtagtggcagcagattatcataaatgtttttcacagtggagatgctctctgaatagatctaaaatcagagaaggaaagttgacttgtagagtgatctagagcagtaaactttagttatcctataatcaccagaaacaatttgcttagattaaaattcagccttctgcacaaagtgttttgtaaaaacaacaacaacaaaaagattcaattgcattgattttatgcttgcttgagaaaggactcatgagtctatgagggtggaacacagatgaagcagtcttagatatttcttaacccagaccttatgcctctgtggccattgtagccagaaagtgcactttgaggaccactttttcagggagcagtgactgaataaacacgagctgtggtggcagggaattgtagacctctattacttttgtctgctcagctcttctccttgttacatagtaacagagcttgacctcctggccaaaaggatgggcacacaacccaagctaggggaatcaaagtcctcttctaggattttttcaaattggagctgggagagagctgcctgcttttcttaatgtcagagtgctctgaaggtgtaagccatggtccacagtgaaagtgaatctgaagcgaatgaaaccagcataaggaaccacaagaagaagaaagagctcagggttccagtaatttctgaagctggctccatccctgcttttcccatgacttggttattgagttgattaattctgctcttgactacgctcatttatattgggcttggagagtgtgcagtgcctcctgactaacggaaggcagaaccactcctcagggatgcagatgtatgagactggataactgtacaaccacattcatcaccttggccctgcactctgattcctaaagaatctgaggcattgcttgtcatgggagactggagtgcagattctttgaattagcatttcagtgtgactgttgttgctttagtaagcctggtctctattcttaactttcgatatttgattttacaaaaatggttattaaagtagatgattgagagattaaggtatcagaagaaagatgaatctattcagttttcctgtagagaaggctaatcctcaagatgtgtaatgtggctgtggtgtcaggctgctgtgagtaggaagggccctgaggaactaatcctcatctcctcaaagccattgtaaacccttcatggggccgagccattcctggtcctcagtgttggccaagggatccttcaagttcgctcaggcttgatcccactgcctttccctcctaggcatgtgcatctctacaaggggttggatgtaaggtatgagtgaaagaagggacatgtggatggccctaccctagaccagtaaaacagattctctaggaggtaggatgaagtcctcatagggtttcccagctcctcagatgattccagtgggcaaccagggttgagacccattgcattatgctatgctacctgcctcaatgctatttctagtttctcagagtcatcttcacgtccccttctttactcttaccttacattcaacccctagcatatcctgttggacttaccttcaaaaatgtgtccagaaccccaccactgcttatggtctccactgctactatcctgcatgcatctcctagctggactattcagttgccttgtttctgatcttcctgcaactatcctcaccctgccccacagtcctctatcaatacaacagcctgatgattttgcagtatgtgtcagatcatgccatgcctggctcccatctcatcagagtaaaactcaaagtcctgtccagggtctacagtatcctctctgatatggcttcctttcctctctggcttcaggtcctaccaattctcctccctactttctctgcagccagactggatgcttagctgttatggagcatgtaaacagtcttctgccccagggcctttgcacttgctattccctctgcctcacagctcacttgttcagtttctttgtgtctgctcacatatccccttttctaagaggctgtcccagactacccatctacagtagcagcctctcactgtgctatattggtctcgctccctggagaagcctttactctccatcccttcacctttcttcttggcacctaataccacctaatgtatttatttattttgtctgtctttcttcactagaatgtcagttccatgagagcaaggacttggttttgttcactgttctctccctagaacccaaaatagtatctcttcaatgatcatttgtagaataaatgaatattatgc

SEQ ID NO: 226 - DNA, 2696 bp, Homo sapiens
tgtccccgcccaaactcatgttgaattgtaatacccaatgctgggggtggggcctggtgggaggtattgggatcatggggacagatccctcatgaatggcttgggccatccgtttggtgagaagtgagagatctgatggtttgaaagggtgtggccccttcccctcactctctctcttgctcctgcttttgctgttgacatgcctgctccccctttgccttctgccatgattggaagcttcctgagatctccccagaagcaaatgctgctacgcttcctatatagcctgcggaacggtaagccaataaaacctcctttcaggatgcagcgagctgagatcgcgccactgcactccagcctgggcgacagagtgagactccatctcaaaaaacaaaatgaaacaaaacaaacaaacaagcaaacaaaaattacccagtctcaggtatttcttttgttgttgtttttggttggttggttttggagcatggtctgacacctgggctggagtgcagtggtgcaatcatggttcactgcaatctcgacttccagtttcaggtgatcctcctgcctcagcctcttaagtagctgagactacaggtgcgcaccaccatgcccagctaatttttgtttttcttgtagagacggggttttgccatgttgcccaggctggtcttgagaactcctgggctcaagtggtccacctgccttggcttcccaaagtgctggggttacagtcatgagccatcgtgtctggcccaatctctgtgtcatcattgtcatatggtgttctttctgtgtgtctctgtctagacgtggccatcttcttacaaggacactagtcttattggattaggagcctactctgcgtcagtagaacggcctaacacacatgcttaacctgctaataatgacaagaacacctacctctatctacagtaatgtgatttacttgtttgcctgtttattccctgcccccacccccaccctcaccctgccagagcagctgtaggagatggaagactttattcctgtggctcttgccacctcctctgcacctaacccagtggcaggcacagagaggggctctgaaattatttcctgaatgaatgggtaaatgaatgaatgacgaagtcaatacatgataatagcaatccttgatgagtgcctgcctgatgcaagcactgtacataattttctttcttttttttttgagacaaagtctcactctgtcacccaggctggggtgcagtggcgcgatctcggctcactgcagcctccacctcccgggttcaagcaattctggtgcctcagcctcccgagtagctggaattacaggcatgcaccaccacacccactaaattttgtagcttttgtagagacggggtttcgccacgttggtcaggctggtctcaaactcctgacctcaagtgatccagccacctcggcctcccaaagtgctgggatgacaggcgtgagcgaccacgtccagcctgtacatgatttcctgtcctccttcagccttgcctccagggagggatagttccctggttttccagaggttagaaaacttgcttgaagttccagaatcactaagggcagaatcccatttcaaactcagcccttctgaactcctgggctcaagccatcctcccaccatgcctggcttattttaaaatgttttgtagagactgggtcttgctgcattgcccgggctagtctcgaactcctgacctgaagcgatcctcccacctaagccttctaaagctctgggatgacaggcgtgagccacagcacacgacctttttattttttttatttttgtatcaagctctttactcccgagcgcactcttagccactcttagtctgcagggaatccacccacgctttttcctttcttgagataagacaagagtgttttcccaaagggccttgagcaccagagagcagaactccaagctgctgtgctgggcgtggaccaggcccggcatggagcccacacagagcctctgacttaggccgggggttctcatcccatttccgtggcctgggaactcagggggaaagagcaattaaattagaggggtcaaagaaggaggaggagggtggggagctggtggccagacccagaaaggccagatttcaatttgcataataattttgttagcaacaatggtcatccaggacatctctttaaaggctgtaatgttaatttaatgggaaaaaagctaatacaattcccccagaatttttcaattaaattaatgtgatgggctttaatggatagcttaagtagagcgtgaataggagaaatattgcataaattatccatacatttatatatgtgctgcccgtgtatgtaatctctccgctctaaggttttgacatatgagaggtcttatgcttaaatctggcaacaagttatgactctatttcaattaaagtgacccttttatcattcaaagaagggggggatgctccttcccatgtagcttccacacagcccttcctttcaacaacacaccagaagattccagtcttaaagaaacagaaggctcgtgtaacaataacccatgagaacacacatgtgcacagaaagtcgatgatatgagaaatctgtagatgcagaatctcgttccctgctctccgctccccaaagacacttgatggagcagaaaataaaatggattaaatttc

SEQ ID NO: 227 - DNA, 1867 bp, Homo sapiens
gtttttaggcctttgccacgcctcgggagcgccacgaactcaacagccgcccaagccgccttccggctcgcggtctgcggacgcgctcggagttgggggccttcgccaacagctgccgtaccgtgccgcgtcgcagccgcacgctagcggggtcaacggcgcggcaggcgcaggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgagctgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtttccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagccattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaat

SEQ ID NO: 228 - DNA, 2550 bp, Homo sapiens
aatttaatagaagatgaaccagcaaaatatataggaagttgctggcagagaattaggacgaaaatctggagacagtggtatcctgagcaccactggaaggcagtatttcaagaaagaagtgtctactgctgctgcaagtaagacgaggtcaaaaggtatccggaccaattcagtgggtgagcaggccatagtcagatattaaaaggtgttgaggagtgctctggaattgaagaaattgaaaggagtatggcattacctgtgttataaaacaaatgatggtctgtcaaacacaccaaaatttttttttctttgcttgtactcttctttctgtatggaactttcactcctccttgatctcttgattccttacatcatcttttaatgtccaggttagataggacctctcctataaagcctttcttagccttagcctctttaagagtatgggcattgtcttaaccattagtgcattcctagtgtttagcataacataaatacttaactttacttatgtaactaataatcaaagcatgggctttggaataaggcagacctgaaattgaatacctgtttagttgcttacttactgtgagaccctgtaaaatgcattttatcctttatcccttgttcctcagttttttcattagtaaaatgtgtggggtggtaataattgtacctatcccagagagtttctatgagtactaaattatataatgcacaacaaaatgcatattaaagtgcctgccattgcaagcaatcagtaaatattagccattatatccattgctttgggattatttctctgggcagttttcaagtgccttaatgatcttctcctgtccttcatctgatacacattcccatatcatttgctggatattcatattatggaatcagaatactgtaatgttgactttctttttcccaggattgattatgtcaagtggccaggcatggaaggagcaaagaaggttcactctgacagcactaaggaactttggtttaggaaagaagagcttagaggaacgcatccaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcattcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagaacatctcaccagactagggatctgccaaactttgggaaattctgcttcatgaatctggggttctagaatgctaaaatgtgaaaggacatttaagaccacctgggacaacatcatattaatgctggtgtttttaacataatatccccacagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttc

SEQ ID NO: 229 - DNA, 2734 bp, Homo sapiens
actgcggccgcttccggacgtgaaagtttgctgcgtagggatagggagaccgggccggattgcggggagtgagcaggttcagcagtgacggcattcttaagagtcctgcccaagtgagggacttggggtgtgggacagagtggcccccagggcagtgggcgttggaaactgagaggccctgcgaaggaggcttggggaggggctacggtgaccaggggacgaggtataggaagaggagggcggaaagccttgagggtgggcttcttggatcccaattgccccagaggcacaggcctgggcatcactgtattatttcccgaggggagaaggggctatttcccatgggaagacaaagtgggatgaatagtggaccttgagaagagggggtggccaggaaaaggttcctgaaggaggcaggacccagactgcaggctggggagggtttgggcagccagagggaggtgagggtgctggagcgggggtcaatcggtcactccggccggagatctgagtggcctctgccccctctgcgctgtggagtgcatctgattgccagcctcgctggaccgttgagaggattcatcgagaccctggatatgaatatgcagtgtgaactgaagtttggggacatgagtaatcagtcacagtggcccaaggtttgaggtgtaaatggagaagtcagaatgattcgctgcagctgtctggaacaggttgggtgagggcaagggtgggaaaggtggctgaggccaggttgtgagaggcctttcatggcaggctgagggggttatactatagggaggattttaaaaagaggagctggtggactggtgagcagggcatataggtgacacctagccaacttgagaggtcagaatacatgattccagaaggctaaggagaaggctgccagtagaggaaaggggaagaattcccagggcgaggaaaacacataagcctttgcgtgtggagctgtgtaaattcaaggtctggccagggggctgtgagatgccgtgtgtgcttggagcacaggaatgagaagtgaggtgaggaagtggctgggccacctcacaaagggcctcaaattctaggctgagaaactcggacttggtcctgagggtaaagggggccgggagaatgttatgcatggtgctgaagttgcattcaacacagctgtgagaagcatctgtcagggtcaggccagtgtgggaggggaactggaggccagggtaccagatatggtggtccaggtgagaaggaaggggccagaacttggcttggagaacggaggtcagtgccctcagggggtggaggtgatggaacttggtgcttgtctggctttggggagtgagtgagtgggtggaaatggggacgtccaaagttctagatggtgtggcaagaattttgtctagatggtgtggcttcctcatgatcatgtcttggggttgagcaggggttctctttggtggggagctgggtagggaggtaatgcttcacttttggatggggcgatcaaattcattcatgtattcattcaaccaatatcgaattgattccttaccctttcctgaaagacctttgatagattctgagggtagaatgttgaccaggatggagctgggccttggagagtggggaaggcaggcagtaacacagcaggcagtagatcaacgaggccatatcatggattgtgctgtgggatgtgaaggaaatgaacagacggaggacgcagagcagggcacctcgagctaccacggtcactaaaagctgctatgaccaagtgttctgtgagctgaaacctgaaggccaggaaggagtcactcttgtgaggggctgaaaggaacatcacagagaggggaggagctagcacaaaagctctccagatgggaggggctggtgcactgggcaagggaaagccagcaccatggtgcccagaagggaaggcagctggggggccagtctacgcagggccttgcagagtgtctgggtttactctaagggcagaggggaaggttttgatcgtagcgcactgcagtctgaaactcctgggctcaggcaatcctgcctcagcttcctgggtggttgggactgtaggcaggcaccaccacctctgcctaattattattatcattttttttggagagacagggtctcaatatgttgctgtgtctcagaggggaaggttttaagtcagggaatgattctgtgagcttaaaaaatcacttggaaattgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcccacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaataggacccgtatttaccctatagcaccccctctaccccctctagagc

SEQ ID NO: 230 - DNA, 2385 bp, Homo sapiens
gataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccacgcccagctaatttttttgtatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactccctttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtatttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgcttt

SEQ ID NO: 231 - DNA, 2467 bp, Homo sapiens
aaagcgacagggtgagtcgcagggcacagtgtgggatgagtcaccgacagcaaggcatggactccgggaagaaggggagacgagccgggaaagacttgcatcggggatgtgagctgagctgcacccagacaaaagcggctcggggctcctgaaagcagcaggcaccgccggtcctgccaaggggctacttcctgcgcggagtaggagagtaggagaccccaggccagtcccaatccccggcccgtccgggatgaggggggctgcgggagctgcgggggcctcctccagggaggacggttgcagggtccctcggccgccgcccactcccgggggcgttccttcctcccagctgcgcccggagcgcctgctgcctggcgagagcccgcccctctgcaaccagcccgctgcagcggagggcgcctgggtgccctcggccgagccagcagcccacggtcggcgccgcactgtcccctggtggcggagcgctcccgcgacccggctcgccacgcctgggaggggtccaggaggacgcggctgggacctgggggctctcagggtggggccttgggggatgaggctggggcccgcgggaaaccgggctggggcgaggaggctcgcaggacttcctgccacagaatgtttcgatgctgtttttaattctgcaaatgtaagcctttccactttaagtccaagctcagcgcagaggactgttctataatacatacaatttagtttaaaaatgttgcaaatgttaacatgtgtcacaaactcaagcaatccagtattatagaaagcaaagaatgaaatgtgctgcttctttctcccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagaggtagggtgtctttaatgaaggggctgggcattaagagcacgggggggaatattcgtgctttccttgggaaagaacggagatttttcccggaatcaagaaacccctttttttctgtccgttcttggtctcttccagtcgttgtcatggcgacatgttgtttagcatgagaacaggatgatgataaagccagaggctcttcagaggcgccatcttggatttcgccagcttcagctggtttcgtcctaagaaggaacttcgaaacacaggcattctttttcctgaaaataagcagttacagctgagtaggaatttagctctgtcccatatgctatcgcattgggcagcaaaagcagggtggggtccagcgaaatcagcaggcactgcaatgagtaacatacccagctacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaaacttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaatgcctgcctgactgaagcttaatgatgtgaggcttctagtgtgataccctaccttgttttaacctgaagtgactcttccttagctaagagagccagacggactccatcgtgactccttcactcgcagcccctcacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagattccccctctcccctgtctaaaccaaagtataaaagaaaatctagctccttcttcggggccaagagaattttgagcgctagctgtctctcggctgccggctaataaaggactcctgaattcgt

SEQ ID NO: 232 - DNA, 1718 bp, Homo sapiens
ctttaatggcagccgggacctcattgcctttctgaatgaggcagctctagcgaacctgttggtcatactgagaccaggaccttacatctgtgcagagtgggagatggggggtctcccatcctggttgcttcgaaaacctgaaattcatctaagaacctcagatccagctgacaacatgaccaaaatctttaccctgcttcggaagtatgaaccccatgggccattggtaaactctgagtactacacaggctggctggattactggggccagaatcactccacacggtctgtgtcagctgtaaccaaaggactagagaacatgctcaagttgggagccagtgtgaacatgtacatgttccatggaggtaccaactttggatattggaatggtgccgataagaagggacgcttccttccgattactaccagctatgactatgatgcacctatatctgaagcaggggaccccacacctaagctttttgctcttcgagatgtcatcagcaagttccaggaagttcctttgggacctttacctcccccgagccccaagatgatgcttggacctgtgactctgcacctggttgggcatttactggctttcctagacttgctttgcccccgtgggcccattcattcaatcttgccaatgacctttgaggctgtcaagcaggaccatggcttcatgttgtaccgaacctatatgacccataccatttttgagccaacaccattctgggtgccaaataatggagtccatgaccgtgcctatgtgatggtggatggggtgttccagggtgttgtggagcgaaatatgagagacaaactatttttgacggggaaactggggtccaaactggatatcttggtggagaacatggggaggctcagctttgggtctaacagcagtgacttcaagggcctgttgaagccaccaattctggggcaaacaatccttacccagtggatgatgttccctctgaaaattgataaccttgtgaagtggtggtttcccctccagttgccaaaatggccatatcctcaagctccttctggccccacattctactccaaaacatttccaattttaggctcagttggggacacatttctatatctacctggatggaccaagggccaagtctggatcaatgggtttaacttgggccggtactggacaaagcaggggccacaacagaccctctacgtgccaagattcctgctgtttcctaggggagccctcaacaaaattacattgctggaactagaagatgtacctctccagccccaagtccaatttttggataagcctatcctcaatagcactagtactttgcacaggacacatatcaattccctttcagctgatacactgagtgcctctgaaccaatggagttaagtgggcactgaaaggtaggccaggcatggtggctcatgcctgtaatcccagcactttgggaggctgagacgggtggattacctgaggtcaggacttcaagaccagcctggccaacatggtgaaaccccgtctccactaaaaatacaaaaattagccgggcgtgatggtgggcacctctaatcccagctacttgggaggctgagggcaggagaattgcttgaatccaggaggcagaggttgcagtgagtggaggttgtaccactgcactccagcctggctgacagtgagacactccatctcaaaaaaaaaaaaaaaaag

SEQ ID NO: 233 - DNA, 2354 bp, Homo sapiens
gttgtgtgctggggtggtgaactctgtgacaagatagagaaggaagggtggggaatgtgggaagcgtggggagtgcggggatgcggtgtggctgggaggggctgcctcagggagtggagggcggggggctacacaggtcaggaaacgtggcccgggcccatcttcccctgtcggcttcctggggctcctggattctactcctggggcccagacccttgtgtagctcgtttctctgtgagcacctgggccctgaccactgcagcgaccatgggtgggcggtgggaggggccctccccggtgcagggcgtcacggctgctgggacttggcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggcgtgctgctgtgaggggtccttgcgtggcccccatccttcccccaatgcagaactccatgggcagggagctggggggccatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctaggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcaaaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagcgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggtt

SEQ ID NO: 234 - DNA, 1851 bp, Homo sapiens
acacatgggcctgtggagcccagtcccaggcaacagtgtccccagagccccagtgatggctgggttgggtctggggcactcccagggagctccccaaggtccgcacgatgggaagactgacaggtcctcaggaccaggccgcagacggacagagaggaccaggctccctgggctcctgggtggggctccgctgactgctggctctccccacaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacacgcaccgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcgtttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacctggcccacgcgtgctgcagatgtggggagcctggaaacacccggcccacgcgtgctgcagatgtggggagcctggaaacacccggcccacgcgtgctgcagatgtggggagcctggaaacacccggcccacgcgtgctgtagatgtggggagcctggaaaaacctggcccacgcgtgctgcagatgtggggagcccggaaacacctggcccatgcctgttcagtccgtcatggcgtttggtttatggtggccgatactaagagccactgaggtctgggttgtgtgagggttagctaccaccctataacctccctaccaggtaataaggagaccaagtctttgatcaaattctgattttttaactaaattttcattagaaagcaagcacaaaataaaatcaaaacaacctttaccttc

SEQ ID NO: 235 - DNA, 2634 bp, Homo sapiens
tgcttgtacctagaagggagacgaggaaacacacatgtagctgagcaaacttaaaccagtgcaccgctgaaaacgagagaaaaaggatacaaacagtccagaaacaatgtactctcctagcatcataagctgaagtctgaagctccactgacctgtagagaagctcctgagcaacaatatctccatagtcatgagaaagaaggttgatcctgcggttctggagccccagatgccgcaaaagcgcttccacgatgctggcctgctcaaatatggaatagtgatgtggtctctgaggaaaggaaagcccacatacacaggatgaagtcatgaggacagctctctctgccagcctgaccctcatagtctgcgtctgcccccacaccccatcaccagccccacataggtgctgcttaccggtttgtcactgaagccaaagcctaagaaatcaagggcaatcacccgatgaaacctcaaggtcagaccttcccaaatctacaagaaagaaacgatgatttgggctttctgctcctgcccctccctttcaccagacctacagttgcacaggagcttcagccccatcttggcttaacagacttccataaagagaaaacgccatgaaactaccacaggtcccacagatgatcctcttggaaaatgctttattcctggtaattaatccctgttgagggagggtaatttggcagtgatcccttccagagtgccaaggagttgtttattcccttcagtaaataaggaacagttcaacatttaatgtttttttaaaagcaattcaaatgtgcaagagccttctggtgctgacaacaaaatccttgaggttttttaaatttttattaaaaaaaaatttttttttgagacagactctcgctctgtcacctaggctgaagtgcagtggtgcaatctcagctcactgcaacctctgcctcccgggtttaagcgattctcctgcctcagcctcccaagtagctgggattacaggcttgtgccaccatgcctggccaatttttatacttttagtagagatggggttttgccatgttggcctggctggtctcaaacccctgacctcaggtcatcctcccacctcagcctcccaaagtgctaggatttgagcccccgcgcccggccgagattttttaagacatagtaggacgtagaagtctgacttcattaccttgtaccagtcgtagctggatgttggaaaaccgtgtaaaagcacaactatctctggacttccaaccacacccacagagtctaggaagaaggaaagtacaatcaattatgccaaatccctataaaaataacctcgaagatgttaaaatctaagtaatctgatacaaagaacaagaaactgtgaccaaattgacattaaaatgacacaattatttgtaaaatgtaagcttaactgcgttaggtgagaacaggccttttctcctttcaatctgtatattaaaacattgtaaaaatcatgctatgtgaaaatacttgaaggcaccttgtttactttcacctaggtgtttttaaacagcatctccccatttctccttttgttctgtaatatgcaaattttttcagtgaaaagtaaattttcagttaaaagcatatgatcacaacacataaactacaaattctttgtactttatcatgaatggcctcacagaaattctctaagatacagcaactattcccaaggaacacctttagcttatgctgtttgctcagcactttttattcagcaggagacccaatctaacatcaaaaacataataaaactattacaaaatcctgtcaactataaaaagggcttaatcaacataaacatgaacttttttaatgcatatgacaatatggaagcattcagcatcatctaaattaggtaaacatttagacaatattaaccttgctaatagtatgggattagaacaggtatattcatatactgccagtgacatgaaaatttggtaataaggttttcaaaaataatttagaagcagttaaaaattgtatatactttagcctaagagttttgttcttgagaatctgtgcaaataaaatcattccatttatacaagtagtatagtttgaaaatgtaaggaaaaaataaactgtatggacatgaagcttttacttcaacattagttttttaaaacagtaaaactggaagtaacccaagccaacataataaaaattgtatacttacttaattgaatatagcaaatgagaggaggtcaggagcaataatgaaaaacggtttatgacaaacatttttcgttattgctcttgacccccgctcaaaacaaatcatttccaatctgtttctcagtttcttcacctataaaatgaggttaatggcacctatctccaaatgctgttgtaaagattaaacaatgaaggctgaaaacataactcagtgcctggcatatggtaattacttgataagtagtggtcataataatcatcatcactagcaaattaatttatataatggtatcaagacttaaatcacagttacactacaaataatctacagaaaaaatgaaatcagggatggtaaggagagagaaccaatggtggttatatctattaatattttatatattacctgacaggttgctc

SEQ ID NO: 236 - DNA, 2315 bp, Homo sapiens
agatgaggggaagcagagaggaggacagtggtggcagactccagtgatgaaagcgaactggggagctttgccatcacatctttgtgaagcattttatctttggatactggagcctatggaaggaagggtttttttgttctgttttttatttttttttgtttttgtttgtttgtttgttttttgagacggagtctcgctctgtcgcccaggctggagtgcagtggcgcgatcttggctcactgcaagctctgcctcctggattcacgccattctcctgcctcagcctcccgagtagtagctgggactacaggtgcccaccaccaagcccggctaattttatgtatttttagtagagacggggtttcaccgtgttagccaggatggtctccatctcctgacctcatgatccgcccgcctcggcctcccaaagtgctgggattacaggcgtgagacactacgcccggccggaaggaagggtttttaagcaagggagtgttgtgatcagagttgtattttaggaagagagtactgccaacaatgttaagaaatggattagagagaagcaagactcctggcacctgtgtttgctctgtttgtaccattttactgctccataccaagagtccaagtggcacagattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcgggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttactcttc

SEQ ID NO: 237 - DNA, 2496 bp, Homo sapiens
ctagcagcgcgggccggtcggaccgccaaggcagccggcgctggcgatgggaagcggcgtggccgccgacacaggcagtggcaaagtttcccagacgtacacatctggacgcgcggctgccggctacccgtgacccctctaggaagggttcagggatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacactggggccaggagctcagccccgaaggccggcgcgtggccctgaagcaattccagtactacggctacaacgcctacctcagcgaccgcctgcccctggaccggcccctgcctgacctcagacccagtgggtgccgtaacctctcatttcctgacagcctgccagaggtgagcatcgtgttcatcttcgtcaatgaagcgctttcagtgctgctgcgctccatccactcggccatggaacgcacgcccccacatctgctcaaggagatcattctggtggatgacaacagcagtaacgaggaactgaaggagaagctgaccgaatatgtggacaaggtgaacagccagaagccaggcttcatcaaagtcgtgcgtcacagcaagcaggaaggcctcatccgctccagggtcagtggctggagggcggccactgcccctgtggtggcactctttgatgcccacgtggagttcaatgtgggctgggctgaacctgtactcacccgcatcaaggagaaccggaagcggatcatctcgccatcctttgataacatcaaatatgacaactttgagatagaagagtacccgctggctgcccagggctttgactgggagctgtggtgccgctacctaaatccccccaaggcctggtggaagctggagaactccacagcgccaatcaggagccctgccctcattggctgcttcattgtggaccggcagtacttccaggagatcggcctgctggacgaaggcatggaagtctacgggggcgagaatgtggagcttgggatcagggtgtggcagtgtggcgggagtgtggaggtcctgccctgctcacggattgcccacattgagcgagcccacaagccctacacagaggacctcaccgcccatgtccgcaggaacgctctcagggtggctgaagtctggatggatgaatttaaaagccacgtctacatggcatggaacataccgcaggaggactcaggaattgacattggggacatcactgcaaggaaggctctcaggaaacagctgcagtgcaagaccttccggtggtacctggtcagcgtgtacccagagatgaggatgtactccgacatcattgcctatggagtgctgcagaattctctgaagactgatttgtgtcttgaccaggggccagatacagagaatgtccccatcatgtacatctgccatgggatgacgcctcagaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagcttcactggcagttctctcagggaggacccatccagaaccgcaggtctaagcgctgtctggagctgcaggagaatagcgacctggagttcggcttccagctggtgttgcagaagtgctcgggccagcactggagcatcaccaacgtcctgaggagcctggcgtcctgacccaccggggccacttccggctgcctctttgctactgtgtagcacctgctgcaacgttgcctgctgtccacgtggggttgtttggagtctggggaaccaggttagtgggcccccaagaagagctttttatttcctattcaattttcatggagtttatagaaagatgctgattggtaggtgatggtatgatatcaaactattttgcagttgtaaataggggacagatggaaaatatttataactgacaataaaatattattaagaaaagg

SEQ ID NO: 238 - DNA, 1796 bp, Homo sapiens
atcttccggccaggatgtgtggtcctggtgagcgattgtcctgtggcgtccgggaccgagtttgtggcccagggttatgtgtgcacttcacacctctgacttttttcagggttcctattgatggttaggagcagggtttcggggatgaaggcggcagcagcaagaggaggctgcgactgcggaccccagattcgtccccctccaccacacacaacgccaagacgggccccaggagggcgtgaagagaagacttcctttcctctcctctcgcctcctggcgctggccgtatgaaggtgtctcccagaagcattagcagaggagccctgtgggagaaatgaggagtgacccaaaagaaacttgctcaaggacagcctccttaaagcagacttccatataccccaacctgcaaaagaagactttacgtgaaatgttacagcccataacagctgcagccttgactattaaatctcaaagggaataaaagagtcgcctgacagttaaagcagaggactacacttggggccaagaatatgggctacttcatatggaagaactccagcaaccgggaggtagctcatcagaacgttaggcatttctgctaccaggagacacctggaccctgtaaggctgtgagctgattctgggaactttgccatcagtggctgaggccagagacccacaccaaagaacagatcctggaattgctggtgctggagcagttcttgactatcctgccagaggagctccaagcccggatgttagagcatcagccggagaacagagaggaaatggtgatcatatcggaggatttggaaagagagcttgatgaaacagaatatcgggtgtgattaaaaggcacatgaacaccctagccagagaaagaagcagccatacatccagggaagcaaggttgcagagctcaatctccactccctcccgcttgatatgtaagtctctatgtttcgtactctcatcctttctggttagctccttacttcttaagggtggaagaagactgtgtcagcattctttctctattctatgccctgagatgtgttctctaagatgtcttttaaagatagtaactgtggttccatcattgagtctttcacaagcccagccatatctaattgttcccaagttgcagccagtgcatatggaatgggactgcactcagaatatcatcatcaagcagcacaggagccaccaactattcctttccagccaatgaaaagacagcttaaatgggaatatccagaattccaggccattcatgagcaaggtgagcatcacagtccatctcgagagaaagggagtggttgaaagctctgccagctacccaggctgaacagcatcaggagcatctcagacataatccaccatgctgaatcagatggaaggtccatctcctgaagtactacattccagcttatgtggcaccaacaagacctgatgcagaatggcgtaatgctgtcctccctcatatcagcctcagcaggaagttgtacaccagcttccgtaatttcctttaaaaagctattctaggccactgtcattaaaaaaatacctttacttttttgtaatattttcataatatataatttcatagcccaacctctactacacacttagtgctttctctgtaaagtagaatttacttttttgtcttaaaattaccttttctgaatcccctggatcacctaaatccattttgtaccctcttttctgttcccttttaatagaagctacatcattgacctgatgttttagactcatctaaacatttttattcttt

SEQ ID NO: 239 - DNA, 2735 bp, Homo sapiens
atgcaggtggaagagggtaggagggatgctggtgccattagcagagagggctagaccagaacatgcctgctttttcaacacatgtaagaagtgcctttcatctcctgccatgattctgaggcctccccagccatgtggaactggaaatccaattaaacctctttttcttcccagtctcagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagtgagctggtgaggttaccaccctgaattgagctccagctgccagtttttgtgtttttccttgcccctttccaagtggttttcaagtgtcaggcagtgttctgagaagcagcagcctataactgtatgtgtgttccttgaagccaggtgcagagttcccagctactgcagcttgggatttggtgggaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggatagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccacc

SEQ ID NO: 240 - DNA, 3402 bp, Homo sapiens
atttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataggtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacaaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattt

SEQ ID NO: 241 - DNA, 2412 bp, Homo sapiens
ttaacccacacaaccaccctaggaggaggtaatacaattcgcctcattttaccagtgacaaaactgacactcgaagaaggcaacacatttctcaaggtcacatggatgacaggtggcacaggatttgaacccggacctatgcaactggaggctctaatctcttacccaccactttgacccaagaaaccacagacatctcttggctcccatgcaaagtctgggtaaagcaaaggggaaccccaacgcccagcagaggcgtggagccccgtcctgggagaggtgtagagattttacatgtccagtcccggtcttcagacctcacagcgatgctgcctttgatgtctcccccaccccactcatcacattcagaagcctggcctggcatccagctgcactctgccatccaccaccccatcttccattcagccacaaggagctgagggctcactccagggcccttctatgaactctgctgtggtcacaaaagctgagtgcacaaaaaacacccagggccttctctgtgtgactttttagatagaaacataattcacgtaccataaaatttaccgttttaaactgtggaattcagtggcttttagtatctttacagagttgtgcaatcatcaccaccatctaattccagaatattttcatcaccccaaaaagaaaggttgtacccattagccatcactccccagcccctggcaaccatgaattcactttctgcctctatgggtttgcctattctggacatttcacctaaatggaattgtgggattctcatgtctagcttcttttacttaggacaatgtatcagtacttcattccacgttgtggttgaagcatattccatggtacagatgtagcacattttgtttattcatttatcagttgatggactttggggttgctttcacttcttggctcataagtcctgctgccatgacgggtatactctgcatgattctgtgcctgttgttctcttagactctgtcagatgcccagctatccttcccccagcctgagaacctcacatgccgggctccttctggctggggggaggcagagcggctgtaccccaggaacagcgggtgcactgcacagagctcctggccaaggagggcacgtggaggtgaagcccagccagttgcctctgtgcctcggtgttgcctttggtcactccacattctttgcatgcctcgctacctcccctgcgcagagcattgtgttaagtcttgaagggatgacagtcagccctctgtgtctatgggttctgaatccctggatccgaccaaccttggattgaaaatatctctttaagtggatggttgcatctgtcctgaacatgtatcgccttttttcttgtcattattccctaaacaacacagtataataactatttatatagcatttacattgtattcattactgtaagtaatctggaaatgttttaaaatgtacgggaggatgtttgtaggttatatgcaaatactacatcatgttatatcagggacttgagcatccatgaattttggtcccccacggacactggaggttgactctctctagctgtatctctgtcaaaggcccacctacaggacccatccacatggctgacataggaatggcaatgtttcttagaaaccacatagcctatggaaaggacatggttcctggggcaggacctgggttgagttttcgccaccccctctacctagcttggcgagcttgggtgattgtttgcccttgtgaagcctctctttcccctgctgtaaaacaggagctgcaatatccagctcataggttgttgtgagaatagaataagcggatgggcgtgaaggttctttgtcccgatacaggcaccgctactgctacaaatgcctccagtctcattgagagttcccataattggccttgccttggaaaatgctgagagaaaccacaaaacttttggggaacctatggaggaaagcaagaacccctgaaaaaaaaaagaaaaaaaaaaaaaaacaagaaaatggcttagggagactggcccatttttgttccagaatattttgtctgctaccttttcctttaacttcctcatactgtctgaaattccacttgcatacgtattaaggattaactttttaatgaaattccactattagagacccattttaaactatccaatccctgtacaaagcaatgactatgaaaggctgtgaggccatcatttactcacagattagtacgaattagttcaaaagcttgctttactattcccactcagctaagatcagcttcatgggaagaatggggccaggcacagtgataatcccagcactttaggaggccaaggcgggaggattgcttgagcctgagagttcaagaccagcctggacaacaaagcaagacccagtctctacc

SEQ ID NO: 242 - DNA, 3926 bp, Homo sapiens
tgaggcccagcctcctggtcaggagcatctggggccccaagccaatgggggctccacaaggcagctcagacttggcaaggagggctcttctcctcaaccttgctgcagccttctgggggcaccccttcagacagcctgcccaggctgtggatccacatttcctgggggtaccacagccagacctaggggcctgggcacgtggtcagccaaaagctgggggcagcagtacagtggggtagtgggggtgggtttggaaaggaaacagtcacccagaacttctccccaggatgagaccacccttccaaggtgggggattgccagggggagaaaacttatttattgctgtaagacaggacccctcctcccaacctcataccccaccgcacaccagagctaaattcaaagctgaaaggcgcacgtttctatacctacattcattcctgagggaccctccagagggtcaaggtcccagccccaggcagccctgtcacagtgagaagtagttcctgtccttaaggaatttccttctaatccaggtgcttgggcaggaacccgatggccttcgggtcaccaaggctgtctgggagggaggcacagggccgccctctgtgctgaggccgtggaggaagccaggaggagggtggcttgctttgcttccttgtctaattagcttgcttgaagatgtggccttggcagggagccagacccatggggccaaggaagaggaagagcatcctcaatagactcactcccccttccttggtctccacgggccccgtggactgagggctgcattggggtcttctgcctaggggaagtgctggacctgagctggagccacttggcttagaagccacaggattcacttttcactggcctttgcagtccccaaaggatcaggtctcagaaccaaggctccaaaggctgaggtctccccagttcctcctctcagaactcccacagtagctcagaggccgggggtcctgccaactttcatttggaaagttctttcgaacatctaaactagatctatcttagggtttctttctctcctagataggatcagctcccagccctagccattaggctgctggtcctggcgggggatggggtcccctcgttacccagtccttcccagggacccaacttcctaacacaacctggcttggacatgaagaccctcccccaggttaccttgtaaagagtcctccagagctgggatcccatgggcgcagcagcacacccagctcccatggcgtcactccctagctctgtcccagcttttgctatcattgctgacttttcctcctgtggctcattctgtccctgccctttgaaaacctaaaataccaagggtgtcatgctggcaactccctgcccagtcctgcacaaagccttggctgtgtgtggcaccccttgcctcctaccccagagcagctggctccattggcttctccctgcaccagccctgtcctcaggggtcaggaaaaagcagcacagctttctttcctctcctccagaggcctggaagggaggtggaggtccagtaagggcctggctgccttggatttcttggtcctgccttgccaactgcaccctgtagctcctgctccctgtgaccccagaaccagaggtgctgccttccctgtctcctagacaaagcacaaagggatgccctgcttggcttgagcctgcccaactgaaggattttctctgccccagggaccttccatccctgaatacaaggctctaggcaacttctctctgggtggtacacactagaatgcctggcattagccctagaaaggaggttggggtgtatgggtagtgagctagggtgggagaaaggtggtgctgaaaggacagatgctagttgtagtttcactcactcattcattcattagtgcaacagtactgagcaccacctgcactagaggcagaggggtgaacaagatacccttctgcctggggggacgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacagcctttccccagccaggagagaccacctaaggatcaaggcagctcctgttttcttggttctgtgacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgaggccaagcctcctctgccactgccagcatggcccaagggaggcttggccttgggcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggccctaccttcctacacagctaggctataatgggcctgagtgagagggtagcttccccagccccaagcacaggcagaggggtggagagcaatttttggttttatttttgtttctgaagtggtgcctgtacctccagcccccagggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggtc

SEQ ID NO: 243 - DNA, 2658 bp, Homo sapiens
atgcgcgcagtcgcggaacccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctcctcctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggtaatgagttggttagcttatatatacgtggtgaaccccctggtattgtagtattaggtgaatagctctttagactgtggcaggaatgcctgactatcctcaggcctgcagatttgccaaaaggactcacaggacccaagactcagcatatagcccttatcagtcatgtaggcctacagactgaccttagttattcaagttctagacctccagtgaaaagcaggtattcaccatcaatcacattgctagtataaactgtctgggaaaacttggtacagcagtggctcaagacctcaggtatgcaaaaacactctgatcaggcagaatattctaattgctcaattctcaggaggcagccaactgccagtcatgaaaataggactttcttgggaatgtgcagggtttggtaaacacaggcctgctgagttaactcttacagcaactctttctggcattcctgttatgtgctagccacagttgtaggcactgggatatagcagtgaaccaaatgtatagaaattcttgctctcgaggaaaagcaatgctggtggaaaagcaatttgatttttctgagcagtaatctttttcagagtgagcttgtaaatctcacctaaaattcagtccccaagggaggtgtggttgctcctccaaatgtttttaatttttttttttttttgagacggagtctcgttctgttgcccaggctggagtgcagtggcacgatcttagctcattgcaagctccacctcccgggttcatgccattcttctgcctcagcctcccaagtaactgggactacaggtgcctgccaccacgcctggctagttttttgtatttttagtagagtcagggtttcaccatgttagccaggatggtcttgatctcccgacctcgtgatctgcccgccttggcttccccaaatgctgggactacaggcgtgagccactgcgcctggccccaaatgtttttaatttatctattcacaagaatatcataatggctttgacaaattcattgctattccatttctgtaacatcccccatgtcctgcaaacctttgtctatcaacaaagaagtgaggattgaacgtattagtttctaagcctgctataacaaattaccacaaacatggtgacttaaaccaacagaaatgtattctcttacagttccgtagtccagaagtccaaaatcaaagtgttggcagggccatgctccctctgagggctttgggggagaatcctttgcctctgaccagaaggtagctctaacagtttccttggcttgtggttgcataactataatctctgcctccgtcttaatgtggttttcatccctgtgtccctgagtctcatgtttccctctgccttcctctttgctttaggcccaccctgaatctgggatgatctccttttgagatgtttaattataaagatccctctccaagtaagatcacattcacaggttctgaagaggagtaggacatggccatatgtttttagaggccacaattctacccactacgaagatggtttggcttgcattgttctttatgaatgtataaatgtatgttagtgtccagtgtttgccacatctttatggttttaaaaaccatctgtataatcttttctaaaattcaggtagcatttcatatcaagcttgctggcatctcttcctcaaagatcgttagcgcattctgcaggctgagcgtggtggctcacgccagtgatccgagcactttgggatgccagggccagaggattgcttgacttcgggaggtcgagactgcagtgggctgtgattgtgtcactgcgctccagcgggggtgacagagcgagaccctttctccaaaaaaaaaaaaaaagattattagtgaatctgtaaccatgtctacctttattttaggattctagataagcttcttaactcttatgttccaaatataaggctctgggaactgttacgggagggtcaagaaatggattcccttggtgtttggggcaaccagagccccgaagctggccatctcccagtaccccagtgtaccctacaaatactggtattttctgtatgtgtcatgatatgaaaaatgttggtgagcactgctttgcaatataattcagcatttgaagacttcaactaacataaagcatttaggcaccctt

SEQ ID NO: 244 - DNA, 3078 bp, Homo sapiens
gctctaggaaagtggcggagcgaccctctatggtcccgggcccacccgaaagcgttgttcgtttcttcctgtggttttgttttctcctccccccaactcggaaggcgtcctgtgacccccgggacctcaagagctgtaaccgcccctgtgtgtggtcgaggcttttgaaaccaaactctagcctctccaacctagaaactgcatactttccacaaaatttgagatttttgagaccctggtacttttcacgaagtcaccttaattatcaccaaaaagctcctgcaagatgggagtggttatactccatttacaggaaaggaaccaaggctcagagaagaaatgtgctccgttcaccgtgtgctcctcctcagccatcctggccgtgctcagtcatctgaccagctgacctccgtgttcccccactccctggggagctcctccgccttttggcttccaatgctattgctgcatgctgaagactcccgcattggtaactccagtctgactgtgggacataaatgttattgaactttagacttgtatatcgaactgattactcaagagctgcatttgcatgtgtaatggacatcccaaacctaacataccccccaaatgaattcctgatatctacctaacctgttcttgcaacagtcttcttcccagggatgggtgaagatcccatcatctttccagttgctcaagccaaaaaccttgatgtcactgttgtctcttctttttttcatccaaaattcacctgtgatttatccacaaattctgtcggcttcatcgttaaaatatattcattatcaagccactttcaacacttccactgctataaccaccaagccaccttcatccaccttctggattattatattggcttccagacgggttgccctacagtctattcacggccccagagtaatcctcttaaacctaagttagatcatgtcattcatttgttcaaaaccttcaaaggcttcccaacttattagagcaaagccaaggacctcgcagtggcacccgatgcctctcatgatctgtctctttagttctttattgtgtctgcagtgctgaaaacagtgctcagcagggaacagacactcagtaaatagctgttgaatgaatgaatttataagatgccttattgtttacaaagtacttttacatcttatcttctggttattcatcttcaccatagtctcatgaagcacagattatcatatctgtcttgcaaatcagtaaactgaagcaagagaggctgacctgcctgaagtaatacagtggtttgttggtggaggctaaactaagtcataggttcattctcttaagttggggctttctgctctgtagggagctgtctctgcatatggcaaagcacaaagctgaatgaggtctggacaaagaagctccactcgcaatctagagagtatctggactattgcagtgattaaatgaggtaatgtaaggcacttagcacaatgtataacacagaagaaatgagagtcgttgttacttttattattaaattgttataagttggttgatgctggtggttggagagtttggggtaaagggcaatggccagagatctagaaatggtttaggaaaagcgtcaggagcaaacatgacccgttgggactgtctgctctatgtacactaaaataaaaagataatttttaaaaagccattttgttagtaaggtagttactaattaaaactaactcctttaatgtctacataaagatggattatccctttttcctatacctgaaaacaactgggccagccatagaagggccagaggtatgtcaactaaagcattgggtaaacgaggatggattttttaaaaagagagagacgaaagtcaggaaataaaggggtgtgtgtccctaagtgtggacagagtcctgggcagtaaggatggagaggagggagagccagaaaaatatatgaaggagaggagggtaaaggagaatgggaaaaagacagggagagaaagcaggtagggttttatgccttcagcctagctgttagtataataatagttaacacttattgagtgcttattgtgtgccaggcactgtttgcagcatttgaggatctcacgtgagattcctgaggcatgattattcctgagggtttgctccaccttctctggttttggtccctgcactttgtggtgtgactccggtgcctcctggtgaaccacatgcctgtcccactgatgttgacttgaccactgatttgaattggctgaccgcatgtgactggatgcaaggggtacatcacatcccagaagaaacttcaagtcattgtgtttctgccaggactctgctctttccctctgccttgagaatagcatgtcccaagtaggggctgcccctttagtctaggaaccaggatgataagacacatggagcagagccacagaagctcacatgtaaccacaacggtcccacgtaatgttagagaaacaaatgctcttgtaacactgagattcttggtggtattattgcattaaagttgactaatgtacctcccaccaaccgtaagagataggaattgttattatcctgtgatattgtgaaatacatagttgatcttctccccgtttcctgacatacaacttctaaaatccttagaatctccaaagtgatgtctttttatatgctgatgagttgactgatgcctggcagcccctgggtagcttcaggatggggctggtcactggaaagaccacagcaggattagaaggatggcaatttcagctccaccccatcaacatctggggaggagggcaactgaaggtgaagtggatcaccaatggctgatggattaatcaatcatgcctgtgttacaaagtctccataaaagctcccaaaggactgggttcagagagcttctggatacctgaacacatggatgttactggagggtgccacctggggtcggggggtgcaaaggggaaggagtatggaagctccgcaccctttccttcatacctcactatatgcatttctttttctatatcctttggaatatcatttgtaataaaccaggaaatgtgtttcgctg

SEQ ID NO: 245 - DNA, 2288 bp, Homo sapiens
actctaccaaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaagaccgagttctgcaatcctgccttcgagcctgagtctgggccaccctgccctcccccagttttcccagaggatgccagctacagcgtcccagctccctggcatggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccacgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgtggaaggatttggtttccatgcctggtaccaggctatggcccctgggcgcgggagctgtgcccatgatgagttccgctgtgaccagctcatctgcctgctacctgactcagtgtgtgatggttttgccaactgtgctgacggcagtgatgagaccaattgcagtgccaagttctcggggtgtggggggaatctgactggcctccagggcactttctctactcccagctacctgcagcagtaccctcaccaactgctctgcacctggcatatctcggtgcctgccggacacagcatagaactacagttccacaacttcagcctggaggctcaggacgagtgcaagtttgactacgtggaggtgtatgagaccagcagctcaggggccttcagcctcctgggcaggttctgtggagcagagccacccccccacctcgtctcctcgcaccatgagctgtctgtgctgtttaggacagatcatggcatcagcagtggaggcttctcagccacctacctggccttcaatgccacggagaacccctgtgggcccagtgagctctcctgccaggcaggagggtgtaagggtgtgcagtggatgtgtgacatgtggagggactgcaccgatggcagcgatgacaactgcagcggccccttgttcccacccccagagctggcctgtgagcctgtccaggtggagatgtgcctcggtctgagctacaacaccacagccttccctaacatctgggtgggcatgatcacccaggaggaggtggtagaggtcctcagcggttacaagagcctgacaagcctgccctgctaccagcatttccggaggctcctgtgtgggctgcttgtgccccgttgcaccccactaggcagtgttctgcccccttgccgctctgtctgccaggaagcagagcaccagtgccagtctggcctggcactactgggcaccccctggcccttcaactgcaacaggctgccagaggcagctgacctggaagcttgtgcccagccctgaccctgaagccggcccctgccctcttcctgcccgtcctcttttgccggtcagggctggcacgcaggggaacaaaggaaggagcatcagcagggtctctacccatccttctctggggctcccagggagggggaagagaagtcctcagctggggctcatgggaccctaccaccctccctgctccttcctgtccctttaccggtcccaggctgctgactggccccacactgtgctgtgctggcaagtgtaagtcccccagttgctctggtccaggagcccacggtggggtgctctcttcctggtcctctgcttctctggatcctccccaccccctcctgctcctggggccggcccttttctcagagattactcaataaacctaagaaccctc

SEQ ID NO: 246 - DNA, 2597 bp, Homo sapiens
aagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaatttttttgtcggctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctg

SEQ ID NO: 247 - DNA, 2601 bp, Homo sapiens
accaggagctccgaacatgcaggcccaaattggaataggagatggattttgataaaagaggttaaataacaggtttttccatttcaccttatacgaacgggatggggggtgggggtgctgggcctccagccaatagaggaccaagagttgtcaggagggcttataaagcttgctatttctggcattttttcctctttctctgctgattatgcagcagactcgcacagaggctgtcgcgggcgcgttctctcgctgcctgggcttctgtggaatgagactcgggctccttctacttgcgagacactggtgcattgcaggtgtgtttccgcagaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccaggaacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggtgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctg

SEQ ID NO: 248 - DNA, 3113 bp, Homo sapiens
aatagacaaagcaccgctggtgccctgagcgacagaactctggtagggggctggctgtaaattgacgtggcatggaaattctccgctaagttgtagcagcttgcatgtttctctaagatcaagcccagcctcctggagctgtagcttaatcatgggttcaatgactttacagaaaaatggatagaaaaattcttcaactcctttctttggacccagatggttttttttggtttttttttttttttttggtttttgcttttttttttttttttggttatctatagtttagctgaaaacaaaatcaaagcagttaagtctgtaactttctttttgcagcttaaacaacagaatttgctgctctccctcccctttcctgcaatttaattccttacagattttgccatggggtgcggacttagaaagctagaagaccctgatgatagcagccctggaaaaatattttctaccctgaagagaccgcaagtggaaacaaagacagaatttgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggcttgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccaccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctcttttttttctctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgcacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcaatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcattttt

SEQ ID NO: 249 - DNA, 2080 bp, Homo sapiens
gtgtatgcagaaaggcgactgtcctaggagtatgaccaaccctccttcaatgctaggcttcagccacctcctcctgaaagctgtcctgtcatccccacccctaccccttatcaactccaggctagagtgggagacccttctttttgctccttctctgtagacccataaatgcccctgcatttggagacccataaatctgatgcctctgtggcaactgccatgccatctgtcatatttaaattttcagctcacatcctgccagccaggccatgagcttttttgaggttaccaggtagtgttagtctcttcagtgctgacacatattaggggtttaacaaatgtttgttgattaaaagaagggatccagaggggccacttttcctcttcccagtgggagctactggttggcattaaagcaaagactgaagggagagaaggaagccaagcgggctcttttggatgcgaggcataactacttatttgcaattgtggcttcctgtttggacctgaacaaaaccgaagtggaggatgccattcttgaagggaatcagattgaaagaattgatcaacttttgctgttggaggtctccgacacctcatgttttactatcaagatgtggaggaagcagaaacaggacaacttggctctctaggaggggtaaatcttgtttctggaaagattaaaaaacctaaggtgttcgtgaccgagggaaacgatgtggctcttactggggtatgtgtgttcttcatcaggactgacccttccaaagccatcacccctgacaacatccaccaggaggtgagttttaacatgttagatgcggcagatggaggcctgctcaacagtgtgagacgtttgctgtcggacatcttcattcctgctctcagagccacgagccatggctggggcgagctcgagggccttcaggacgcagctaacattcgccaggagttcttgagctccctggaaggctttgtgaacgtcctgtcgggtgcacaggagagtctgaaggagaaggtgaaccttcgaaagtgtgacatacttgaactgaaaaccctaaaggaacctacggactacttgactctagcaaataaccctgagactttgggaaaaatagaggattgcatgaaagtatggatcaaacagacagaacagcgtctccagccccgtgcaatggctcgtgtttttccccgcgcatttgcaggttcttgctgaaaacaatcagctgctgaaggaagcggatgacgttgggccacgagcggagctggagcactggaaaaaaagactctccaagtttaactaccttttggaacaattgaaaagcccggatgtgaaggctgtgctggcagtgcttgcggcggccaagtcgaaactgctgaagacttggcgggagatggatattcgaatcactgatgcaactaatgaagcaaaggacaatgtgaaatacttgtatacacttgaaaaatgttgtgaccctttgtacagcagtgatcccctatccatgatggatgctattcctacacttataaatgcaattaaaatgatctatagtatctctcattactataatacctctgagaagatcacatctctgtttgtaaagatgacaaatcagattatatctgcatgtaaagcctatattaccaataatggaaccgcttccatctggaaccagccacaggatgttgttgaagaaaaaatactatctgcgattaaactgaaacaggaataccagctctgctttcacaagacaaaacaaaagcttaaacaaaatccaaatgcaaaacaatttgattttagcgagatgtatatttttggaaaattcgaaacttttcaccgacgccttgccaagataatagacatctttacaaccctcaagacgtattcagtcctgcaagattccacaattgaagggctggaagacatggccactaaataccagggcattgtggcaaccataaagaaaaaggaatacaatttcctagaccagcggaaaatggattttgaccaagattacgaagagttttgcaagcagactaatgaccttcatgtaggttgtataataaaattcctgttgac

SEQ ID NO: 250 - DNA, 2284 bp, Homo sapiens
cactggtgttgagaggctggcctgcggtgatgtggccaaagaggaagagctgggctggggtgagtgttggtcacatggttgaaactaggtggggaggggagtggtccaggggagagtccaggcccagctctgctgggacttgccatgggggtcacgactcatctgcagggaaggtctgggctttatctctgagcacctctgtgtgctgctcaccctgaagtgggggtgggcctgtgcctggcctgtcccctcatcctgggagctcccaatgcccatctgcaaggctgtggacccctcaggagtggcctggagcctggctcccattgccacatggtggctgtgtgtgtggagagggttgatagtggagtggtcaggcccaggctgccctgggggatgaagtgccatcctctgggtgccctggagaaagaagagaactcagtgagccctgtctggtactttcctggaggagggctcccatgctggccctccacccctctgtcccctgtcaccctgaggcctctggatttcctctctgcccttcccaacctgccaacttcacgggtttctggctgggttctggggatggcccctaggggagacgggccaggcacaagcggggctgtgtcaaggtgggtatgcaggggtagcacaagtgtgcagagcctggggaggcatgggcaaagcatggcaggcggcggggcaggggatcttggaaggtcacgggctggggagcagtgtgggcagcggcccagaggtgggacggccgtagcttagctgggtgtcccctttctgtcctctgcaggtggagccccctgagctgcccgctgatctgcagcactggatctcctacaacgaggccagcagccagctgctccgcatggagagtgggctcagcgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctcccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcagacgtcttcttaactcctctgtcctctatattcagcatgttccttgtcagctgctgggccggccctgccttgcgctagcagagcctctcctggcagcttctcaggtctccctaatggagacaccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgc

SEQ ID NO: 251 - DNA, 1957 bp, Homo sapiens
ggggcaggaagaacgcacggatggagacaacaggaaggaaagagaccttcctggtcacacttgggccacaggagaacaggcagcggcccaggaggatccagggtcctgatggtggttgagaagctggttcttagtgatcactcagaaacgtcggcctggccttgtggggtcagaccttgcatctcagtcagcccagggagaagaagaagatggtccacacccaagtgcagggaacatcgtggcagtcggctgggtgcctgcgtccaggcgaggacacctcccgcatcagggaaacacacgtttctggagtgaggaggctgaaggcagggcccagaggagagctgagccatggaaggaggtgtgtgcatggatggtgagctagagcaggtgcaggtgcctcagggaggatgtgtgggacgaactgactcagggaaccataagaaatgctttcaccaaacaggagaaacctgaaggtctgggtccagagcctcagatcttacactggcagcacacagggacacaacagttggactggcagcaacagggcttgcagcagctggactggcagcacacggggacacagcagctggactggcagcagcagggcttgcagcagctggactggcagcaggatgatccacagcctgaggagcagcaacagggcttacaacagctggactgggagcagccacaagaaccacagccccccttggaacccccacaggagccacagccccccttggagcccccacaggagccacagccccccttggagcccccacaggagccacagctggtgcaggaacaggctggcacccaggtgcacacgggcttgcagcagcagacaggcacataacatctggagccacatcccccacagctggagctgcagcccccacagccagagccacagcccccacggccggagccacagcccccacagccagagccacaacccccacagctggagccacagcccccacagccggagccacagcctctggagcagccacagcagcccatggttctggtggattgagggtggagcaggtagaggagcaggtgagagggaggtgcaggtgtggagctccctgagcctgggctctttatatacctgtccagatgtcaggcatgacacagggtccctttcttgtgactgtttacactatttttccagagctctatttttttcctctttgctagtgacttccttctggctcagttgagcatctactttctttgttttctaaatttgtctttttccccatttgttttggcccctacaattaaaacctcagctccaggctgtctggttcttcctgcaaagctccagggtgctggtcacctgctctctgctgaccacatgtgaccaatgggcaacagcctctgcccacgtgctctcatctttcctgtgttgactccctcaataatattaattttacatttttagatttcaaaattatccacgatctttatactcatgccagtctcagctttccgggtgtgttagaccattctttgcattgctctaaagaaatacttgaggctgggtaatttataaaggaaagaggttagaatggctcatggttctgcaggctgcacaagcatggcacccacctctgctcagcttctggggaggccctcagggagttttcctcacggtggaaggcgaagcaggaacaggcacaccacatggtgagagtgggagcaaggggtgaggaggagccacacacttgtgaacaaccagatctgagtgaacacactcatcgccaagggggtggcactaagtcactcatgagggatccacccccatgacccagacacctccctgcaggcccctccttcaacactggccaacaactatatgaaaaaatgctccacatcactaactattcggggaatgtaaatcgaaaccaccacgagataccatctcatatcagtcagaatggcttttgat

SEQ ID NO: 252 - DNA, 1747 bp, Homo sapiens
cacagatgcaacagactcacaggcattcactcttacatatgacacagttgcacacttgcacacacacacacacacacacacacgcactgcaatccccttgcatctccacagtgtcgaaggctggctgaacaccaaggtggctcttggtggcaggacttctcatgggagggaaagtcacatagctggaaggttactagcttagggacataatttccttattgactataatctccttatagaaattcaacaactatagcagaaaatggagaatgaggacattttatttctcaaagtcaacagttccttttctcctgcaccttcggagcaggctcctgcctgaggctgctgaggtgctctgggttctcgctgtttgttttcagcatccaggttcaggcttttctcagtgcattttcctcggctgcccttggacttgtgttgtccggggtggtggccactggcccccagtggctactgagcagggagagcagggcccctctgtggtgaggcgtgctgctcggtgtaaaacacacacgagattttccagatgcagtactcaaaagcatgtgaaactcctcagtcatcacttaaaatattgatcacaggttgaaatgattatattttagataccttaggttaagtaaaatatattattgaaatttcaccttctttttgctttctaaaaatgtagctcttaggaactttgcaattacctacatggctatttgtgtgttatcttcctgctgggcagtgtgagaccttctcacagatccttcagaaatgtcaaaggaaaagcaaaaatggtggagaaggctgagcacgtggcctcgcgggaggccggctcagagctgttctgaagttgcttttgtaacacaatctattctcaaagctccttttctttcaatggggcaggttgggggtgggggggggggatattacaccttgtattttacttctcgattcattttctttccattttaactttaattccgtctaattactgtattgtgagctcagtcagcaatcttgcatgaactctgcagtaacttctgaagactcttgctccaagtgtttgataatgaggagatgtgcaggactaaggcgactgtgtgatgtctgcacagttcgaaagcccgctttcctgttactttcaaatctcgggtcagcattttggaacttttctgctttaatttttccacacacacctctcactgcgaccacctaccatcaccacaacccaaaacaaagcaaacaaacagaaagcttgaacaagaatttacatctgggaaaacgcttctactcatcaagagtggaattcctttttattcctataattgactcacagcttcaaaaatctgtgaagtcatactttggtcacggaagttgcaagaaaccatatttgcaaacgttttattttaaagaaggtatttaaaaatatttcacatattagccacagatttctagaagtgaagttataaaaattagaaattatatttttccttttgatgatagcaagtgaaaagagattgctccaagcatgttttcaataaattcagtataactgcaacacaaaaattctgcatgcaggcttcatacacacacgttataattttatgcatttatcttgagagttgtataattaattttaaaaatgcaacagaaatgtgaagttaagtctactttgccaataatggaaatgtctcatagataattttgaatacaattaaaattttgtttttatcataaaagg

SEQ ID NO: 253 - DNA, 2626 bp, Homo sapiens
gtgaatacctgcaagtccgcagagtgaagagacagcagaatgagatggctgagcgattccatcatgtcactgtgctccagatacacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcaacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgtgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcccccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagacccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttc

SEQ ID NO: 254 - DNA, 2352 bp, Homo sapiens
attctgcttttatctagttgacacatcggtttcctccattgatattcctaaaaggaagggacggctggggcccgttgtcactccctgcaaggcgcaatctccaggcaggggcagggcaggtctgggggcttcacgccccccagggagcgggtcacccggtgggactcgcgcccgccctctccttgggtgtcgtgttccctgggacgcgcccaccgttctccctggggagcgggaggctccaggcgcggctggggcgctgtgggcagatgcgctcggtcctcaccagcggcgttgtgcggcgaaccctgcggtgcttcgggaaggcggtcgttcctccctgctcccaccgttttccagcgtgtgcgctcttaccttctctggggaaaaaaggaaattttttattttttaacatttcatttcatgaaaccgttttttttaagtggtggcgctgaacacagtccttgcagaggggggcagcactttccctcctgaccccaacctggaaaccccagtgtgacttcagcgctgtcagagcattggaagcagagctgcgagttaggaagcggctcgctggcagctgggcacgtttctttcctgcgagatcggcttttttgatttgctctttttcacatgaaaatgttcagcttcatttttagacacctttagacatggttatcactgtttaaagccttgatttttttttaaacaaatagtttgcattttattcattgaaacagggagagaacaaataccatcctgctttttgggctgccttcctatttcaaggaaagacgccaaggtaattttgacccagaggagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacaatcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttgattgtgcggtgttggatcttagaagctgtgatggctcagatgcacatattggctgaggataaccagctaagtgatttcaccagcttgttttaaacatagaaaatcctactgtctaattataaatcttgaaagatcaagctgattttttatttctttttttttgagatggagtcttactctgtcacccaggctggagtgcagtggcacgaactctgctcactgcaaccttcacctcccaggttcagggagatgtgcattgagcaggatgggagagtccatctcactgttgtttactttggg

SEQ ID NO: 255 - DNA, 2663 bp, Homo sapiens
aggcccagtactttgcatgtgagcacagacccaggtgtttctgaacctggtggtccagggactgctgcaggaaggagccaataggactgcatgccttacaggcagtgggtctcatccatccctatctatggcactgactacaggccatgtccaggccacatgggcacatgctattataattattttgtgcgatggatgagttacagaactggagccctaagacctgagttctagtttcagctctgccagttgctggctgattgaaactgaacaagccacctgccttccctgagactgtctcttctcctgtgaaattagggcattagaatacatgaagacccctttatgtccttaataacctgtaagtttaagaacctagggaatctccatgctggtggctgcggttatatccccttatcctcaactcgtgaagaaagagtcaaaaatggcagcagggttgtgtcaactgctctcctcagcagctatcataagggaattgcctttgtcattttccccagccatcaccacactcccacacggccaccatcacctaaaccatctggcagtgggggttacctcctaaatctaagacgcagagacccaccgcaggcctttctttctggctgccctccactcccacccagaggctcagttttgctgggctgcacacctccgaggactcagttctttgtgtttcatgttgtttcatatccactagtgttacagaaactgctgcaaaccagggaccaaaagtccataggttctaattctagctgtgacactagtgagatgagtgactgctggcaagttactttatctatctgacctcacctcccatgtacaaaattgggtctgtatgcacatttgtggttctaaatcctggagtccaaatcagagttctttgtgcaaaatatacgtagctaggtcctaacctcggagatcctgactcagtctggggaaaggcgcagatcttggggagaaaacaactctttagaagagtctcgccttcagtgagtgacaagatctctcctgtctctcggttcacaatgttaccctaactaatccatcctctgatgtcacctgctaacaacttcccctgtggcatcaaaccagtagcccatttgcagctagtacaaacacttctttacatttaagttttgtttacgagatttagcctacaatcatagaggctgccagctgggtttcaaatgtgtatgttccattgctaataggaaaaactgcatctattagaaaaattctctctgggagctgggcacagaggcaggccttgtattgcaaacatttgaaaagccataagcaggtattctggactgtgttttagatcacctgagaacatttcttgaacactagtatttgcttagagtgacaaacctattaagtggttctttcaggtaagtttgcatccaagcaatgtcgtctgaatcgcaggaggaagccaggagttgtgtctggctttctggccatacaaatggcatatgggaaagtcattgtatattattaatatcctttgatgtatattattatgactttctcacggtagtaatgttgttggtttttattaatgttatttttatagcaatgctaatattatgagctaaaagtttctgagcatctgctgggtgccaaaaattcttataaatgctttacatgtattagctcctaacaacactttgaagtaattcttattgtccttacttgacatatacaggaataaaaacctgaccattagaccgagcgtggtggctcacgcctgtaatcccaacactttgggaggccgaggcaggcggatcacctgaggtcaggagtttgagaccagcctggccaccatggtgagaccccgtctctactaaaaacacacaaaaaattagccgggcgtggtggtgggtacttgtaatctcagctacccgggaggctaatgcaggagaatcgcttgaacccaggaggcggaggttgcagtgagccaagatcgcgccattgcactccagcctgggcaacaagagcaaaactctttcaaataaacaaacaaaacctaagcatttgaggggtttggcctgggcagtggagcttgtgagctatatgagctggaatctgagtcaaggctgggctggtgaaaggagttcactcaagttcccaaggtattctgtcctccaggactctgaatcacctgggaggagaaggaattgtggcgggcctaacaccttttctttcccaaacaccaagagcaggttctttctgttacatccattgaggtcacattcttgaagtgcattttgaggaagtcattattttcgctacagcagggactgatgtatcagtctattagaattcagaaaaaagtaagcaaacaaaaaacgtgttggaattattctcttctagcattttgaaatgtacaatggttaatgttaactatagccaccatgatgtattgaagaccaggtcttattctttttatctaactgtacatttgtacccattaacctaatgctcatagcatcaagaaaagatcaatatttaaggtgacaaatatcccaattatgctgatttgattatatgaatgtgttgaattatcatatgtactcccaaaatatgcacatctaagatgtatcaataaaaataaagacaaaaattaaagcttttacagt

SEQ ID NO: 256 - DNA, 2925 bp, Homo sapiens
acgaaggggcggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgaagaagtttgtcctgaagaattatggagagaacccagaagcctacaatgaagaactgaagaagctggagttgctcagacagaatgctgtccgtgtcccacgagactttgagggctgtagtgtcctccgcaagtacctcggccagcttcattacctgcagagtcgggtccccatgggctcgggccaggaggccgctgtccctgtcacctggacagagatcttctcaggcaagtctgtggcccatgaggacatcaagtacgagcaggcctgtattctctacaaccttggagcgctgcactccatgctgggggccatggacaagcgggtgtctgaggagggcatgaaggtctcctgtacccatttccagtgcgcagccggcgccttcgcctacctacgggagcacttccctcaagcctacagcgtcgacatgagccgccagatccttacgctcaacgtcaacctcatgctgggccaggctcaggagtgcctcctggagaagtcgatgttggacaacaggaagagctttctggtggcccgcatcagtgcacaggtggtagattactacaaggaggcatgccgggccttggagaaccccgatactgcctcactgctgggccggatccagaaggactggaagaaacttgtgcagatgaagatctactacttcgcagccgtggctcatctgcacatgggaaagcaggccgaggagcagcagaagttcggggagcgggttgcatacttccagagcgccctggacaagctcaatgaagccatcaagttggccaagggccagcctgacactgtgcaagacgcgcttcgcttcactatggatgtcattgggggaaagtacaattctgccaagaaggacaacgacttcatttaccatgaggctgtcccagcattggacacccttcagcctgtaaaaggagcccccttggtgaagcccttgccagtgaaccccacagacccagctgttacaggccctgacatctttgccaaactggtacccatggctgcccacgaggcctcgtcactgtacagtgaggagaaggccaagctgctccgggagatgatggccaagattgaggacaagaatgaggtcctggaccagttcatggattcaatgcagttggatcccgagacggtggacaaccttgatgcctacagccacatcccaccccagctcatggagaagtgcgcggctctcagcgtccggcccgacactgtcaggaaccttgtacagtccatgcaagtgctgtcaggtgtgttcacggatgtggaggcttccctgaaggacatcagagatctgttggaggaggatgagctgctagagcagaagtttcaggaggcggtgggccaggcaggggccatctccatcacctccaaggctgagctggcagaggtgaggcgagaatgggccaagtacatggaagtccatgagaaggcctccttcaccaacagtgagctgcaccgtgccatgaacctgcacgtcggcaacctgcgcctgctcagcgggccgcttgaccaggtccgggctgccctgcccacaccggccctctccccagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacagggagctgaagaagaagccgccgccacggcccacagccccaaagccgctgctgccccgcagggaggagagtgaggcagtggaagcaggagacccccctgaggagctgcgcagcctcccccctgacatggcggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagtctcttactcccatttctgctgcctttggccctgcctggcccagcctgcacccctgtggggtggaaatgtactgcaggctctgggtcaggttctgctcctttatgggacccgacatttttcagctctttgctattgaaataataaaccaccctgttctgtg

SEQ ID NO: 257 - DNA, 1978 bp, Homo sapiens
agatgccggtcctgcctctctcgcggcccccagcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagt

SEQ ID NO: 258 - DNA, 2068 bp, Homo sapiens
taagtatattattatatgttattgttaactataatttacctactgtactatcaaatactagaacttattccttgtatctaaatgtattcttgtaaccattaactaacttttctgaatttcctactctccccttcccttcccagccttgtaaccacctttctactctgcctccatgagacccattttttaatctcccacatatgagtgagaacattcaatatttgtctttctaggcttggcttatttcacttacattaatgacctccagttccatccatgttgctacaaatgacagaatcccattctttttcataatattgtccatacataccacattttctatatccatttatctgttgatggacacaggttgcaaagggattgctggattgtatgataattctatgtgtagtttcttgaggaaccttcatggtgttctccatagtggttgtactactgtacattcctaccaatggtggatgagcgttcccctttctccacatcctcacaagcatttgttattttttcttttttttcaaatgaacattttaactggggtgagatatcttaatgtggtattggtttacatttccctaattatggttgagcattttttcacatatctaatggccattcatatgtcttcctttgagaaatgtctatacagatctctggccctttttttaaacttttttttttttgaattggggtcacccagtctggaggtgatctgggcttccacatcctgggctcaagtgatcattccacctcaggatgacccaaatagctaggaccaaaggcgagtgccaccatgctcagctaatttttttgtattttttgtagcgactgggtttcaccatgttgcccaggctggtcttgaactcctgtgctcaagtgatccgctcaccttggcctctcaaagtgcaggtactttaggcgtgcctggcctttttgtccattttatttttttgagatggagtcttgctgtgtcacccaggctggagtgcagtggtgcgatctcgactcagtgcaacctccgcctcccaggttcaagcaattctcctgcctcagcctcctgagtagctgggattacaggtgtgcaccaccacacccagctaatttttttgtatttttagtagagagggggtgtcaccatgttggccagggtgatcttgaacttctgaccttgtgatccacccaccttggtctcccaaagtgctgggattacaggtgtgagccactgcgcccagcctgtccattttttaatcaggttatgggttttttgctattgaattgtttgagttccttatatattctggttatgaatcccttgttagatggtgtgttaggccattcttgtgttgctataaagaaaatcctgagtctgggtaatttataaagaaaaaaggtgtaaatggctcatagttctgcagactgtacaggaagcatggcaccagcattgcttggcttctggggaggcctcaaggaactttcactcatagcagaaagcaaagcaggagcaggcacatcacatggcaagagagcaagagagagaggtggaggagatgccacacactgttttaaacaaccagatctctcaggaactcattgttgttagaaaaggaattaaaagaaatcaaagagtgtgtaagcagaaactcagttgtacgtaagaaaacccaattccccctgagaaagagagagagctggagtcctttaaaaattcactgcctgtttttctggtggctagtgagtgttagctctcctcccttcccaggcattgtgaagaccctgtttccctagctgtgcagctgcaaggtcactagacagataaactcaagtcgcaaaacatgtttttccttgaaaagtaagaaatgatgtaatgcatgtcttgactgaataactgtctttgtttcttgcttctgtaatatgcttccccctgcacagatctccccctgccccacgaaatgcttaaaagctaacttaactctttgttcagggctcagtcctttggatgttaatctgactgggccggagcacctaaataataaatattctcctgaacccc

SEQ ID NO: 259 - DNA, 2254 bp, Homo sapiens
aaaaggccaggcgattcaagatggcggaggacctggacgagctcttggatgaagtcgagtccaagttttgcacacctgaccttctaagacggggtatggtcgagcagcccaaaggctgcggcggcggcacccacagtagcgaccggaaccaagccaaggcgaaagagacgctcagatcaacagaaacatttaaaaaagaagatgatcttgacagtcttattaatgaaatacttgaagagcccaacttggacaaaaaaccctctaaattaaaatctaaatcttcaggtaacacatctgtcagagcttccattgaaggccttggtaaaagttgcagtccggtgtaccttggtgggagctctattccatgtgggattggaacaaatatttcatggagagcatgtgaccatctgcgttgtatagcctgtgatttcttggtagtcagctatgatgactatatgtgggacaaatcgtgtgattatctgtttttcaggaacaacatgccagaatttcacaaattaaaagcaaagttgataaagaagaaaggaacacgggcatatgcctgccagtgtagctggagaactattgaagaagtgactgaccttcagacagatcatcagcttcgctgggtttgtggtaaacattaagaatgcagactgcacattcggacagatgcatccatgagagtggtctccatgaatcatcatcatgtttagacattagtccctagcaataccattccctgtgggaaaaggcagtgaattttattgatacaactacatacatttttgaagaccaaatggactaaggaagatcatgtattataacactttggaattattcctgatacatggatgtttcacttagtaacaggcatctacattctttactaatctgtcttctgtttaatagaggtttgattatggagttccatacaaatatctagtttttcattagcaactgcaatattgattgctaatacgtttagcaaatcattccccaacttgtagcagttaaagtggataaagccggccagggcaaagagatcatttaggggtgtctacaacacttcttccagtcagatcttttgttgccaaagatcataatttggacatggcagaaaccaggtgatcagtggctgactgaagggtgttcagaagtagttacaggtattttgcaaaaacactgcctcatagctgatcttacctcatcaactcaaagcaatgttatgcacaatattaaatacatgttaccagttttagcttatttttccctcttttgttcatttaactatcaaaagttattttctattttgattacccaataatatataaaaagagtttgatgcacccaaaatcacaaaaatcctaatacatacaggttattgttggattttccaagtactttctatcctttaatgcctaaaactccatcaagggaagtaaacagcaagtaatataatttttcaggcagcctgtggacttctctggtaggatcaggttgacatatcgtttattaggtgagtaagtgaaaagacaagtaaagcataactgaaccaacaggtaacctgttgggctccttcctgacatcactgagatctgaggagccctacaatagcagcacattcaggaaatcaggtccctcaaaatttctagctcccaaccccattgagagattttgggagctttccaatctgccacaaactccctgctacatatgtactatatagttcaaatgtgtgatacagagcaccctgaaagggaataattgaaacaaagttataatcttcttagtcttatgctaaatttattccagccaccctactgaagggaggaagatctgatcattagaatccttttcctagccatgacacatttacatacttgtaaaatttattgtagtaagtctagcattgcaacagaatagatcttataatggccaatcctcacacttttgtattaaggatattatgacagactaagcatggtagctctcgcctgtaatcccagcactttgggaggctgaggcaggcagatcagctgaggtcaggagttcaagaccagcctggccaacatgataaaacaccgtctctgctagaaatacaaaaattggctgggcgcggtggtgcatgcctgtgatcccaactactcgggaggccgaggcaggaaaatttattgaacctgggaggcggaggttgtagtgagccaaggtcgcgccactgcgctccagcctggacaacacagtgagactctgtctc

SEQ ID NO: 260 - DNA, 2198 bp, Homo sapiens
ctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctggtgagctgagcacccacaggctgggcctggctgcagtgctctgtgtggcttctgccagcgctgcctgggagcagtcagctgtggggcgggctgtctcctgctgcaggccacgtgggtggcctttcaggaccctctgggcagtgagtgctgcgctctggagtgggcgaggccctatcctggccagtaagacaccctcactgccctggagcacgcagctgggtgcgtggtggaaggaccccacggcaggtggggtcacgcaagaggcctcccctggtgcctggcactggggcagacagtgggaggtgagcagaaccacctccagcacctgcttgattcccaggcctcgatcccctctgcatgtgaggctgtggggaggcacctctgacctggtgagagggccgggtgctccgcctccagctttgctccagagcaaggcccaatggcagactccgtgccctgctcagggtggggtccctgctctccccaggaccctgcagcctctgggcccccttcatcgtggcccaggatggggtcggactgctctgcccccaggcgcgtctggccgggccggtcctaaatgctcctctgccacagctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcatacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacgcggcaggccctgctatcacaccttgggcttggaggtcattgggagtgagcagatgtgggggtggccagccaggctggccgcactccatggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtaggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgg

SEQ ID NO: 261 - DNA, 1599 bp, Homo sapiens
ttttgtatgggctgcagcctgccgctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcaggggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctc

SEQ ID NO: 262 - DNA, 2868 bp, Homo sapiens
aaaagcaaatcatcgggaataacccgggagcctggcagggaaaccgctgcactatggagaggacgcttccagatacagaggacaaatcaagtgaagggacggaacaggtcacacccagagcggcacagaggtgtgtgagctgttcccacggtagtcagagcctctgttccaactgtcctcccgctgggctctcttcggtccccagtgcatgggctggagtgtggcccctggcagagccctggaggccggctctgcttcctgcccccttccagcctggagcagcccgagggcgcagcattcctggggcaggcctgagccctgtggtgggctgagttgagtccccagaaaggtagattgaagcccaaactctctgtatgtttgaacgtgaccttatttggaaaaagaatctttgcagatgtgttcaggttcagatgaggtcatcctggattagggtgagtcctaaatccaatgctgtgaccttataattgggggatgcacagggagaggccgcatgaagatgcaggccaagactggggcgatgctgctccaagccaaggagcaccaaggactgaagacacccgcggggcgctgggcaaggtgcagagggattcttcctgggggcttcagaggagggtggtcctgcccgcacctcacttttggacttctactctccggaactttgaaagaacacatttctgtggttttcagccacctggtttgtgggaattgttatggcagccccagaaaacgaatacaggcaacatcacttagtgcttaagaaagagcctgtgcccgggcgcggaggctcacgcctagaatcccagcactttagaggctgaggcaggaggatcgcttgagcccaggaatttgagaccagcctgggcaacaaagtaagatcctgtctctacaaaaaataaaaacattagctgggcgtggtgatgcgcgcctgtgtttccagctacatgagaggcagaggcgggaggatcgcttgagcccaggaagtcaaggctgcagtgaaccatgttggcaccactgcactccagcttgggtgacagagtgagaccctgaaaaaaaaaaaagtctgtgggcccacgtctcacatcctgaccccgccggcgatcaactgtgtgaccttgagtgagttacttaaactctctgtgcctcggtctccccatgggttgtggaagggttgagttgatgagtgtaaagtatgcagacaacagccaggtgcccagcatgatgtaaacaccgcaagagcactggctgttgtgaaaggtgccgtgtttaagaattggagtttcccaatgggttcagtattagtacctgttctttagggcacagacttgttctgtgccattttacctgtatccatttcaaccagacttacatcttttcgaaggaaggcctgagaaaatctcaattctcaactggagtgatgattcaaaccccttgtttcccttccttttctttggggtctctgttagtttcctgtggccaatgtaattaattaccacaagcagggagcttaaacatcagaatgcatctttcacaatctggagaccagaaatccaggtgcaggattttacagggccatgctgcctctgaaggcaccagggtagggtccctcctcgcctctcccagtttgctggcatgccggcaaggctcggcactccttggcaggcaccagccgtgctccaatcactgcctgtctttgcatggtcatcttcttgtgtttctctgtatctctcctcgtataaggtccttggtcattggattcaggacccaccttactccagcatgacttcatcatcacttaattacatctgcaagaaccctgtttccaaataaggtgacattcttaggtactgggggtgagtatgtatcttttcttcaacatatctttttggtggaatgcaattcaacccagaacaccacctctcacgaaaacggctaaaaacggctggggaggcattttcaagaactttcactaacaaattttaaagaatagatttcactgtaagccttgggcagccactgaagagtgtgttggaatagctgctgagtgttggccactactgggtgacgtttccttaatggctggaagagtgaaggaattagggccgagcgtgtatgcacaaaaacttcttctgttttgactgtatgggcttcttcctttcatttgttcatttagcaaacatgtattgccttcttttgtcttctacgatctatgaaagataaaatgtggtgtgaggacacggcccagccccaccgtcgtcttccagccccaccatcgtcttccagccccaccgtcgtcttccagccccaccgtcgtcttctagccccaccatcgtcgtcttggactctctgggtggcaccacgctgtgggtgctgctctcctctgtgtcccaaacgagtttgtgcctcactttgtcgggttttggctgtgacttggagcctcaccaagctcccttttcctctgtctcccattctcctctccaggccagggtggcttccccagccctcctccccgggtcctgcctgtgccgagccttcctcccaggagggaggtgatactgacttgagatcttatgggtgttttgtttgtggctgggcctggccgaccctctctccacggccttagatcacactctggatggataggacagtcgtcctcaatactgagcctctttggagcatacccactgatggtggttcacaagctacccacgcccacaggctgacccagatctccgtgaaattaaaaaatactgtgaaaggaaaaagagccaatgtcatgtggataatgaagtgtcagccactgaaaaatctcaaaataataaacatggcttgtttgtcagggttctctag

SEQ ID NO: 263 - DNA, 3153 bp, Homo sapiens
aggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacacagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacagttgaggaaactggatccagacgttggagtgacagacctgtggccacgtggttagcggctggcaccgggactcattcttaccctttgctttttccctctcattcgaagctttctgttgtgaaataaaatatacacaggaag

SEQ ID NO: 264 - DNA, 2663 bp, Homo sapiens
tcttggagactgaaagttggactcgtaggtactgagcgtcttgttgtggagaccagatgcaatgcctgggcctcctgctccagctcccatccagccctgggtcaaagcctgcaggcgaaggacaggacagcagagtgagctccaggatgtggaggaaggaagatgagaaataattccctgactggtgtcccttccgtttcgggatgaattgtcctccagctgctcctgattcctgcgttaaagtcctggtgtgatggctcacatctgtcatccctgcactttgagagttctggaggccacaagtgtgaaatcaagatgtcagcagtgccatactctctctgaagtctgttggagagaactcttctttgtctctcccagtttctggtggtttccagcaatccgtggcttccttggcttgtcgtcgcatcattccagtctcagtcatcatgcggcctcttcactatgtgtctgtctgtgtttacattttcctcttctcataagggcagcagtaaatggattaggcatgctagtatatcttcttcgcttgatggcatctgcagactctgtttccaaataaggccttgttcatgggtactggggttaggacttcaacacctcatttctagtctcctatatcaccatgaagaaagctatgctagaaagctatgtctttgttacttatacaaagtggtattgataatagctacttactcaaaactactcagaataagatcagtttctagcatgacagtatgaggagccgcctgacccactcctccaggtaaactggtaaaaacagccatttaaggcttctggaaatagtcccaaggaaaaacagcaaaggaaggaacctgtattcaagaaaatgtactaatttggtagaagaggtgaatctgtgggatttgaaacaagaccacttctttcctccccactcccagctcagcacggtggcaatttccctccagacagctactgctgaaacacaggtctcctctcctcccagcacagagggcctccttccagggaggagtaggatggcagtgtccttcatcctgcccccagctccctgttgctgaggctgtctcagatgaatgcagttgagaggtgggggctgccacccctacctgctactcatggaaggagactctaccttgggtgtgacatgctgagaagactgtggccctggtcacttttgccctggctcttgaggtggtgtttccatgccagaaggctcaagttaagaagaccactggctatccccaactcctccaccaagcacccagcccctaggcagggggtgtcactcagagaaaagcttaccattgtttctacccccagctccagagctctggttcagatattttgttgcaaggtaggggagaagaagcagttcagagaaaaaaaggtaattcttaatctcttcccaagggaactgacttcattttcaacagagcttggagaaaattaagcctaagtatgctctgaaaacacagtggaggttgtggtgaagggcaattgggagaggctagtttgcaggagagaacccagaataaaccactgggaaggaacccttctgggggtcagaacaaatatcaaacactgacctcagaaactattctttcaaaggagccacagtttaatggggttagtttgtggaacactctatgccccaggatattgttgaaaacaatagggcaattggccaccaattaatggagcttaacagctggatgtggttagggaagtgccagagagccctagcaaaaccactgtcatcccagcacgactgtgggcatatgcaaagctgaacctctttagggagcaatatgagaggcttaacgctttgggagggaaaatatacagttgacctttggacaacacaggtttgaactgcgtgaatccacctatacatgaatttttttccaccactgccaaccttgagacaagactgacccctattcttctccctcctctgcagcatactctacatgcagatgttgtggataaagatctttatgatgatctactttcacctaatgaatagtaaatgtattttctcttccttaggattttcttaataatatgctcttttctgtaacttattttactgaaagagtacagtatataatacatataacacacaaaatatatgttaattgactagctgtgttatcagtgaggctccttctggtcaacagtaggctattagtaaagttctggggcatcaaaagttatacacaattattttactgcataggcagtcaatgcccataacccctactttgttcaagtgtcaactttacttcatgaaaataaaccaggcagtcactaaaaacaatcaataagcaaataacaataacaagtcctgaaggagggaaagaccaatatccagagtcagtagaatatattatctaaaatgtccagtttctcacaaaaaattacaaggcatgcaaacaaacaagaaagtataatatgatccatacacctgaaaaaaagcagagaaagaaactaactttaagaatgataagacataggctgagtgtgcctgtaatctcagcactttgaggggttgaggtgggaggattgcttgagcccaggagagtgaggctaggcatctatcacaccactgtgctctagcctgggtgacaaagtgagaccctgtc

SEQ ID NO: 265 - DNA, 2888 bp, Homo sapiens
aggcgcacaccaccacgcccggctaactttttgtgtgtgtatttttagtagagacagggtttcaccatgttggccaggctggttggccaggctggtcttgaacttctgacctcaggtgatccgcccttctctgcctcccaaagcgctgggattacaggcatgagccaccatacccggccaactttcaagaatgtttttaagattttgttgcataccaaaagtgttctttatatattctggatgcaagtctcagacataatgatttgcaaatattttttcttccattctgcgagttttaacttttttgatagcatcttttgaacaaaaagtgctaactttttatgaagctaaatttgtctatttttttcttttaccacttgtgtttttgttgtcatgaagatttactcctgttttctcttctacaagttgtgtggctttaattcttacatttaggcctacaagccattttgagctaagtttgtatatgctgtgaggtgtcactgccctcatggttagagcccagaaagcaagagagaaagccttctccagcctgacctgagccctccctcttctgttcctgactcccatccggcagtagcttcactcactgatcgtggttggagcccttttgagctctggggaaggatggacagaaagaagagtatcccctggttcccctgagttatcaagcccctgtgggaggcagttgggagggacatgaggcagattagcacagggcatctggagccagcaaagcagttttagagcgggagcctgcttcggggatgcttgaaggtgggcactggggtcaggctgctggctcaggcccagctggtcttgcagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaactgtatgccttccaccctcggcgtccagtgtagacggtgctgccctggcccagactatgcctggagccaggctgggggcaggggcaggacacccggggccacaacccacactcgggataaaacaacctgtgcgtgctgtttaataagctcccagacatctgattgtttttccttccctgctctcccttttcttcctctagtttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgtttttttttggcagagataatcgtgtcttaaaagttgtttttaaatgacaataaaacaagccagaatgtc

SEQ ID NO: 266 - DNA, 3690 bp, Homo sapiens
gagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcggaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagtgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtactctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctctgcttttcttgtgatgggattttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagtatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaatctgatgcagcacatgaagctcagcacctcacgagacttcaagatcaaaggaaacatcctagacatggttcttcgagaggatggcgaagatgaaaatgaagagggcactgcatcagagcatgggggacagaataaagaaccagccaagaagaaaaggaaaaaataaatgaaatgcctgagttaatgtg

SEQ ID NO: 267 - DNA, 2563 bp, Homo sapiens
attatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacccattatggttgataatgatagctctggtacaagtgataaggatcatagtgaaatacttgatggaattagtaacaaaaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaattgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtaggcgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtatttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagc

SEQ ID NO: 268 - DNA, 2734 bp, Homo sapiens
agatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgactgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcgtataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcacaactaaataaagggctgcatgcttatt

SEQ ID NO: 269 - DNA, 3258 bp, Homo sapiens
ctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccaggttagtgttttcacatattctttttcagtgtggttacgagtgtataagatttgatcctaagaataaatttcaatgtgcagtatagagaactgatattttacagtatagtaggccaaagtggaatttggatatgtactctaatttcttagatattatacattccaggagtagcaggatcaaggtgagctcataggaagaatagtataataggaaaattaagttcggcaggatttagagtaatgtgatgaattagatattcataattacgatagctataagtgccccaataggcatattatttgtgattttggtcatgggaaattgacatgccaggaatagattattcatatattaccttatgattttctcaggtgatcatcaggacgcgtaagtataatacttctaatgtccttaagtgttggaaccaacaccacagaatcaacagcctaggagaagacacatgcacatatgtatacacacacttacaagcatgtatacctgcatttatgcacctttcctagtgtctcttagctcaattctgtttagctcaactgtaattatagtacagacatgtctaataaccagacttcagtccttgaactccttccactggctcattatgagtcatcattttttatattttaccacccttaacctttttttggagtgctttctctaccttggtttatactaaaaatacatatttcatctcacctacccttccatttcctatcctctcacctcctgctgtccccaagacacttaatctttctttatattttttgaatggaggatgctcgtgttctcaattgatcttaattctcactttgcaattaatacagaggctgtgtagaatgaatttcttcaatttttttactccttcagttacaaacttattagcatctggactcattttcctttagcttctgctcatttcagaaagagatgctaatttcttctgaaacttactctgaatatcagtctttcccatctccatgttcccatatcttaaatctctttttatttactcactttttcctttcagctagaaatgcgtttaggtctcttatcctccctcgctagccccaaaccaaaaatttcattatccttaatctttagccatcacatccattcatcagatcttgttgagtcttcctaaatacctggccttttcaattgccaatgcttatgaatgagattgaactctcatcatctctagctatctgttctcacgttcattcatggtcccaatttgtcttctactccaacttgtagtatgaaaattatgtactctatgcaaagtatgtaaaagtatcacatatttcattgatttccattatgtccttctgaagtgtatagatttgtgtcatatgttcactcaactaacttggatccacctaacaaaagtggacaaataacagaaggcacaaaatagataattttgactgccagtctattcagtgagctttcaactacaggtaatagatgttaaacagccgatttatattggggaatctttggtcagaatattaatggtttctcaaccttgagaaagaaatgaaactgttcatattgctttaagtgggaggtgggaatgttttttaccatcaaagaagaaactaaagattaaattaattgagggacataaaggagcagtgttagagaaattgataaaatgtcagtgaatactcaagggtgatttgatgaagactattttttgctgcatggttagcctttgaccttcacagttcttttgacctcagcaaatgaacctacttctcaatctaaaatttggtcctcatttggcaaatgaatgaatttaaacattgagaatttgtggcttattcatttatgtagtaattaattcattcatagagatgggactagactgctcaggattgaaaagagttaattttcagctggagagcactttattacttgtgctctccctgaatgacaactttaaattgtttgattggttatcctttgtggtttagctattgcctgcatagtttaatgctgctttttttggaattaccatctttaaactttttgctcacttccctcaatccctctgaaaacttttataaccttttacccatttttaggttaacatctaaatctctatcataatttaaatagttgcaaagtatgtattgtcttgatgtatattaaactacatttttaaaagaaaataattacagtgctttttgtatgcagtggaatcttgataccatcattcattttttaaaatacacaaactctttaacatcagaaattttataatattcctctttcaccttgaacttgtattccagtatcctcacaagagttttatcctaatataatacattttatgtttgagattcttttttattcatcaccctgtcaatactttttagttacaaaatagacatttttaaagtttttcaattccttgttattctttaaagctctaaattttaaaaatttcatttggccaggcactgtggcttacacctataatcccagcactttgggaggctgaggcagaaggatcactggaggccaggagtttgagaccagcctggcaacatagtgagattccatctctacaaaatcaggaaaaaaattagctgagcatggtgatgcatgcgtgtagtcccagcttgggcccagggagtcaaaggctgtagtgagctatgaatgtgtcactggatccaccttaggcagtagagcaagaacctggtctatctc

SEQ ID NO: 270 - DNA, 3217 bp, Homo sapiens
caaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctgagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtc

SEQ ID NO: 271 - DNA, 3058 bp, Homo sapiens
aatttctccgtaatttccactgcttgaaggctgctcgaggaacaggagcagcggcgaaacccaggtctgtcggtttacgagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatctgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatcgcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagccccccctccccctatatgggattctctgaaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctct

SEQ ID NO: 272 - DNA, 3684 bp, Homo sapiens
gtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggagcctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatagcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtc

SEQ ID NO: 273 - DNA, 2790 bp, Homo sapiens
ttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggcgacagataagggaaggacaccccctgactccaggcccctgagcctggcgggaagtggctgcggcccaggcagccagtcctggtggtgttctccctgcatgccctccgtggctgggctgccaccccacccggcccgaatctgtcttgacctgcaggaatacgcgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttagcatttgcacggtgtcttccccggacagcacagcaataaatggtgtgattgcgtgg

SEQ ID NO: 274 - DNA, 2745 bp, Homo sapiens
tacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaataaaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagc

SEQ ID NO: 275 - DNA, 3022 bp, Homo sapiens
gctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtat

SEQ ID NO: 276 - DNA, 2796 bp, Homo sapiens
ttaaagtttctcaggccctattagtagcctgaaggaaatactaatgactggccttccgcactaagccaaagtgtttgctcttcatagcactcaaagcttatcagcgcagagcccataatttatggagataaaaggaaaggagatataggtaagaagagtgtgaccaggagaccttatgctacctgtaaaaaagttcagcccaccccatctaacttctgagctctgtttgggtgaagattttctggccgcatggctgctcagactggcatccaggctttgctccaccaagaagttaaaggcagtcggacatctcagtagcatctctaccagcccttaactcaatgcatctacctggcatctcccagcagttacttttggagacgattcactgcccctggggcgtttccttgaaggtttgtggagagcgtggagaatgatggggcaatggccaattggagggtggagagtgaagagccggagctggctgtgagtggtttggccacatttctcaggattccatgagagagttggggaacttgggctgacaaaggaagtagcctggggcatccttaaggaaggaattaagaaaagggaaaaagctggactcaagccacgccatgagggtgaaaggttataaggccctgccccctttccagctgcccacctgttcctcctccacacctcttcgctttgggccaccaagaaccaatgaagtccacaccctttggatgagaaaaagagggagttggttggcctctcttctccctgttatccaatttgaggatattttgaccttgggtaaggatgaagtgttaaagccacagctcctctccacaagaagccattcatcttgggggaggcagagagggaagtctctctccaaagtctatccagcttcgcttcgtttcattgatctgcacaagagacaatgctctggaaaaggaagaggaccccagaagggtgcttggcaagacagaggatgctaatgggcaatggagagcactccctccagctggcccctgctgctgcctcccgtcctctgcatggggtcaggtgcttctgtgcttgctgtcctacctctctccacagcagggctctcaaaaccattttgatcccccattggcagagggttcccctctttacagagttcagtcattaaaagcatggatcagctgttaatctcattggaggagggaactgtttcctgcattcattcatctgggaaccttcttgagtagccactgtctgccagccactgctctagagatgggaaaacagcatggaacaaaaccaaggtctttcttccagcgaatttatatccttcaggaagctggttcctgccaccaacttagcaggcaacagttctcctcccctagtggcacagggtaccagttttgtaggaaaagtggtccagcaaaggaagaaagcagaccaacccagctgccttaccttattctggggccattcccccagcgatgagagctgctcttgtttctactgccaccatctcttctggctgcacttcacctgctgcttgagcttctgaccttccttcagttccaccaaatgaggacaggaaatagcagtcaagacccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaatt

SEQ ID NO: 277 - DNA, 3031 bp, Homo sapiens
agtctggtctaccggcgcggcgtagtggatgcagcatcctagtggaggacgcccctgtggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggtgagtgctgggagagctctgccgctgcctctgggccgagctcgtccaggacagtagtggggcctcccagctgagggggctcaggagctagaagttattggcttatgtagacagaggggcccactcagcgtttctctcgggctccctggaggcagcctcatcttccttcctctgaccttgccagggccttccgtgggccttggtgtccaggcccctcccttcctgtcatctctgctttggggtggcttctccagggcctcccgagggctggcctggcgtcttaggctgatgcacaactgctctgagcctcgaccctcactttgtcctcagtacaagtaaaacagaaacttttctctcctttgagaaggattttgcagccccagaccagacctcgtctctcgcctggaacagtgggaggagccgtgggttgaagaccgggagagacctgagttccaggcagtgcagaggggaccccggccaggtgagtgctgggctgtctgggctcggcgggccccgtccctgtggcccacagctcctgggtagtgctcagcacgctgcagtgaccaagggtgtgtccttcccatgggagagcagacacacagctgctctctaaattagacaggcattagagacgtaggggcagccacgctcctgccctgatggacactggccgggggtggggctcgaaaggcatagtgctgcaggatgacatacagctgcagctcggaggggcctgaggctggagtgacacttgaagcctgcacctagccacccaggtgctgtccggcggaggccattggtgtgggtgtctgacctccctgtgatggccatgtggggtcccaggcctggtactgactgcacgtgagggtctccaggtatgtggctctgggtaggagtttgctccacgtccttgtttgcaaaactgggacagtggccatgcttccctccattaggtgagggttgctcttggggcagttgtcagcagggttttgctttttacttacattttcagagtgggatggagcagctatgtgaacacgagccctgggaggtccccgggtatgtggagtccccgactgtggagtgtcaggttcctaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcgttcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagccgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagttgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaataccgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaaggggagacccccgtgggaatgggtcgggacactgccgtgtttcaggttagccaatt

SEQ ID NO: 278 - DNA, 2763 bp, Homo sapiens
acagccgggaacgcgcctcgcggatgacaacaaattcgtcgcgcggcggcagtggcggtggctgcctcagcccctgccgcctcctctcgcgctctcttgcactctctccgagccggttgggaccctcctcggaagtcccctggcctggggccaggaggacccctctgcgtcttgcctccgccaggcccagcgcgagcggtgcggcgccggcgatggggtctccctgagggactcccggcaccaaatagggatggaggggccgccccaggcttaggccccgccgcggcctggagccggagtcgctaccccgaggccggagccgtcgcaacccgcagccgcagtcagcccagctgccagcagtcactatgccttggccgttttcggagtctatcaagaagagggcctgccggtacctcctgcagaggtacctgggccactttctgcaggagaagctgagcctggagcagctcagcctggacctgtaccaaggcaccgggtccctcgcccaggtccccttggacaaatggtgtctcaatgagatcttggagtcagcagatgcacccttagaagtcactgaaggattcattcagtcaatttccctgtcagttccatggggctctttactgcaggataattgtgcactggaagtgagaggattagaaatggtcttccggcctagacctcgcccagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacagtactaagaagagtaaaagtcacttttatagatactgttttgagaattgaacatgtgccagaaaattccaaaactggaactgcacttgaaattcgaatagaaagaactgtgtactgtgatgaaactgctgacgaatcctcaggaattaatgtgcatcaacccactgcttttgctcacaagttacttcagctctctggagtgtctctcttctgggatgagttttctgcatcagccaaatcttccccagtgtgttcaactgcaccagtggaaactgagccaaagctctcacctagctggaaccccaaaattatttatgagccacacccacagctaactagaaatttaccagagatagcaccttctgacccagtgcagattggacggttaattggtaggttggagttgagtctcacgttgaaacagaatgaagtgcttcctggagctaagttggatgttgatggacagatagactctattcatctactcctgtcaccaagacaggtgcacttgcttttggatatgttggcagctattgctggaccagaaaattctagcaaaataggattagctaataaagataggaaaaatcgacccatgcagcaggaagacgagtatcgaattcagatggaattaaaccggtattatttgagaaaagattccctctctgtgggtgtatcttcagagcaaagcttttatgagacagaaacagctcgtacaccttctagccgtgaagaagaagtattcttctccatggctgatatggacatgtctcatagtctctcttctcttccaccccttggggaccccccaaacatggaccttgagttatcattaactagtacatatacaaataccccagcaggatctccattaagtgctactgtgcttcagcccacttggggagagttccttgatcatcataaagaacagccagtaagagggtcaacatttccatccaacctagttcacccaacacctttacagaagacatctctcccatctagatctgtttcagtggatgaatcaaggcctgaacttatttttagactagctgtgggaactttttcaatctctgtgcttcacattgatcctttatctccacctgaaacgtcacagaaccttaatccattgacacctatggcagtagctttctttacttgtatagaaaagattgatccagcaagattttcaacagaagattttaagtctttccgagcagtgtttgcagaagcttgctcacatgatcaccttagatttataggtactggcattaaagtatcctatgaacaaagacaaagatcagcttcccgatattttagtactgatatgtccattgggcaaatggagtttttggagtgcctatttccaactgattttcattctgttcctcctcactatacagagcttttaacgttccattccaaagaagaaactggttcccattcccctgtgtgtcttcagcttcattataagcattctgagaatagagggccccagggtaatcaagcaagacttagttcagttcctcacaaggcagaattgcaaattaaattaaatccagtgtgttgtgagctggatatcagtattgtggacaggttaaattccttgcttcaaccacagaaacttgccacagtagagatgatggcatcccacatgtatacttcatataataaacatattagtctgcacaaggctttcactgaagtgtttctagatgattcacatagtcctgcaaattgtcggatatcagtacaagttgccacaccagcattaaacctttctgttcgcttcccaatacctgatcttcgatctgatcgagaaagaggaccatggtttaagaagtcacttcagaaggagatcctttatttagccttcacagatctagaatttaagactgaatttataggaggatcaaccccag

SEQ ID NO: 279 - DNA, 3276 bp, Homo sapiens
atgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttgctctgtcctggtaacattctccttctaggagagcatctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagagcagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataac

SEQ ID NO: 280 - DNA, 3180 bp, Homo sapiens
agtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaagtctattttggagaattgaaataattcatggaagggaatcactattccgggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtt

SEQ ID NO: 281 - DNA, 3543 bp, Homo sapiens
acggtgtgcgaaccgaacagaataacccgcccccagcgggatgtgaaggactccgggtgaggccggccacgccccgcacggatgggaaggccattgtgactatgtggtgattacagttgtcttactactgagcttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagtctttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactttacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattg

SEQ ID NO: 282 - DNA, 2551 bp, Homo sapiens
aaaaccttcggcggccggcgctgtgcggcgggcgcggttgcgcgcggcttggggcaaatacttctcaccactgcatgaatggacatttgaaagtgccatagccaaacacttgcaagcatggagacctcatcaatgctttcctcattgaatgatgagtgtaaatctgacaactacattgagcctcactacaaggaatggtatcgagtagccattgatattctgattgaacacgggttagaagcataccaagaatttcttgtccaggaacgagtttcagactttcttgctgaggaagaaattaattatattttgaaaaatgtccagaaagttgcacaaagcacagcacatggtactgatgattcctgtgatgataccttatcttcagggacctactggcctgttgagtctgatgtggaagctccaaatcttgacttaggctggccatatgtgatgcccggactcttagggggcacccatatagatctcctttttcatccaccaagagcacatctacttacgataaaagaaactattcggaagatgataaaagaagcaagaaaggtcattgctttagtgatggatatatttacagatgtggacattttcaaagaaatcgttgaggcatcaactcgaggagtatctgtttacattctgcttgatgagtccaattttaatcattttctaaatatgactgagaaacaaggttgttcagttcagcgtctcaggaatattcgagtgcgaacagtaaaaggccaagattatctttcaaaaacaggggcaaaattccatggaaaaatggaacagaaatttttgttagttgactgccagaaagtgatgtacggttcttacagttatatgtggtcatttgagaaagctcacctcagcatggttcagataattacaggacaacttgttgagtcctttgatgaagaatttagaactctctatgccagatcctgtgtccctagttcatttgctcaggaagaatcagcaagggtgaagcatggaaaagccctctgggaaaatggcacttaccagcattcggtgtcttcattagcatctgtttccagccagagaaacctttttggtagacaagacaagattcataaactagattccagttacttcaaaaacagagggatatatactttaaatgaacatggcaaatataacataagaagtcacggatacaaacctcattttgttcctaactttaatggtccaaacgcaatacgtcagtttcaacccaatcagataaatgaaaattggaaaaggcatagttatgctggggaacagccagaaacagtgccatacctcctgcttaatagggctctgaatagaaccaataatccacctggtaattgggaaaagccatctgatagtctcagtgtggcgtcctcatcacgggaaggctatgtaagccaccacaacacacctgcccagagttttgccaatcggcttgcgcagagaaaaacaacaaatcttgcagacaggaattcaaatgttcggaggtcttttaatgggacagataaccatatccgctttttgcaacaacgaatgccaacccttgaacataccacaaagtcattcctacgtaactggagaattgaatcctacttaaatgatcattcagaagctacaccggactcaaatggatcagctttaggtgaccgatttgagggctatgataatcctgagaatttgaaggccaatgccctttatactcattctcggcttagttcctctttagtatttaaacccactttacctgagcaaaaggaagttaacagttgtacaactggctcctcaaattcaactatcattggttctcagggaagtgagacacctaaagaggtcccagacacccctacgaatgtacagcatttgacagacaaacccttgccagaatcaatccccaagctcccattgcagtcagaggcaccaaaaatgcacaccttgcaggttcctgaaaaccactcagtagccttaaaccaaactacaaatggccatactgaatcaaataactatatatataaaaccttgggtgtaaataagcagacagaaaatctaaagaatcaacagactgagaatctacttaaaaggcgaagtttcccgttatttgacaactcaaaagccaacttagatcctggaaatagtaagcattatgtatatagtacacttaccaggaatcgagttagacaaccagaaaagcccaaagaagatttgctgaaaagttctaaaagcatgcacaatgtgactcataacttggaggaggatgaggaggaagttaccaagagaaactctccaagtggcactactaccaaatcagtttccattgctgctttacttgatgtgaataaagaggaatctaacaaagaacttgcttcaaagaaggaagttaagggttccccaagttttttgaaaaaggggtctcagaagttaaggtcattacttagccttaccccagataagaaagaaaatctatccaaaaataaagcacctgccttttatagattgtgtagtagctctgacacattagtttctgagggtg

SEQ ID NO: 283 - DNA, 2946 bp, Homo sapiens
attcttcttccccagagagccactccatctgagggtggctgcgtgtccacatatgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacctggccttcgtgtgtctgagtctcttcactgaaaggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttaaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgacggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacaggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccacc

SEQ ID NO: 284 - DNA, 2538 bp, Homo sapiens
acaccatacaaatgttagttctatatggccaagacatctgatttaaatttgatgaaacacagcatgtcattgttttctagaacttaaccattttcgcttctagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtggggctgggtatctccattggaagtctcattttatgcctgatcatcgaggctttgttttggaagcaggcttagtacaagtaaggatatatctataccagaaattagggcaaggagtgggtcagacaaaggtgaaccatataaaatgactgaactgcaatggaccttaaggggcatctggtttaccaacctcattttgcagatcagaaaacaaaagaccaaggggccaatagttcctctggtagcaatagttttgaattagaagcatggtcacttgattcctagtccagtgctgtattagtctgttctcacattgttataaagaactatttgagactgggtagtttataaagaaaagaggtttgactcacagttatgcaggatgtacaaaaggcatatctggggaggcctcaggaaacttacaatcatggtgggaggcgaaagggaagtaagcacatccttatatggtgacaggagagagagagagagagagagagagaaagagagagatggagagagaatgggggagatgctacacacttttaaacaaccagatcttgtgagaactgtatcatgagacagcacttgggggatggtgctaaaccattagaaaccacctccatgatccaatcatctcccaccaagccccacctccaacattgggaattataactcgacataagatttgggtggggacacagagccaaaccacatcaggtgctatgccctccacatgatgctctcttaggaaggttcaagtattaagacaagtaagacagaaagaaggaaataaatatctaggaatcagaagaactcaagtcacagaaaagaaggaccccaagaccagttcacagatactgttcagcaagtagatttccatattgagcagaacttctattccagccagagaccttgcttctgctgctgcagtagaaaaccccagaatagtattcatcagaggactgtggaatgtttacttctccctttgtggatctcagtttcctcatctgtaaactggggaaggggattagattctggggtttcttcttgctcttgccttcgttgcctcaattctggacatgagcaatagttgagactagttcgctccaggcagatcccaggtggcttgaacagaaaacagcattgtcagttgagaagaacaagaaggaaaatggcgggcacttgggcgcctgagtggacttaatgttgagtggaaggggactgccttcctttgctgctttccaagttagcctggtgtagtaaaagtagatgggagcctcaagaaagaagtaaaattccaaatctagggccgggtgcagtggctcatgcctgtaatcctagcactttgggaggccaagccgggcagatcatgaggtcaagagttcaagaccagcctggccaacatggtgaaacccctgtttctactaaggatacaaaaacaattagctgggcgtggtggtgcatgccggtaatcccagctacttgggaggctgaggcaggagaatcccttgaacctgggaggcagaggttgcagtgagctgagatcatgccaccgcactccagcctggctgacagagcaagactccatctcg

SEQ ID NO: 285 - DNA, 2305 bp, Homo sapiens
aagtggcagactttctaattaaggcaggagccgatatagaactagggtgttctacccctttaatggaagctgctcaagagggtcatttggagttagttaaatacttaatagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaacgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttc

SEQ ID NO: 286 - DNA, 1971 bp, Homo sapiens
tttattgatgttttatgcatttctcttattagtgagaatacgcaccatctcatggttagtggccattgatctccatgttgctaaatcatgtgttcccttgcttatctttatctgccttgatgttgaccatcctttgcttctcaccacagctttctcttggttctgcagtaacgtgctcttgttttctctggacctacctcctcatccactgttagacctctcagtgtctgactgccttagactgggttattgcccttgtttcttatcttcactttgtgccatcagatacatttggatggcagtgatggacaaattcatgtcgccagccccaaactggagcaccagactcatgcctcaatgcctccttagtgtcctcacttggctgtttaataggcatatccacttgaacactgccaaagtatgcttgaatcccaccctcacccccaacactaaaaacaaatattctccttctccagggatttccatcttgttgaaaccacaaacataagtatactctagagtctcttttcttgctcaccttctatatacctgttgctgtcttcctgcttgcattctgagtctggcatcctttctgttcctgggcttaaccatgcttttcctgccttcagacttttgtatcatttacattgctctgtgcttagccagcccctgagagaggtattccctgtccaccccaatccagtggagggcttcctagtcactctatcatgttacttttattttcttcacaggatttatcttgtatatttgttcatctgtctctgccctttgaaaatttagtttttgtggcagcaagggtcttgtcttctggttcactgccatataactatctagagtagtgataatttatatttgtgtggattgctcattaatactctacgtacattttactgtcttctaaggatctcttctggattaaggccattaactcatcgttataaattttctagtttatcatttgtcttcaaaccttgttcatagtgttttcttacgtagactatttacgtgaacaaataaacaggcaataggagtcatcagtctttgctttcttctgagttttgttgcattttgaaaatgtctgatttataccttttttctggtctgtataaatcgtttttcactgtacctgctgtttctctgttagaattgtttaaaaaatgatttttactttattttacttaaggcataagaagttctccgtggttaaaatattagtacgtgaactttgtcatctatgaacaagttcctttagaagctgagctctgatagtgatgtcaaatagccacctgttacttgaagacgatgtttgcatacctggcccctcctttatcactgctgttgctgccattgttgatgacatgatgtggaagggcagtgagaaatttgatacttgttcatctatctgttggactcaactagtagtgttgctttagtttttaatctttttatctgaaatggagagtctattataatttgtcattttattcattgcagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattattcggaatttttatagcttacttcacaatgtgcccaggtcagctgtataaaataaatactgcattgttgttt

SEQ ID NO: 287 - DNA, 1558 bp, Homo sapiens
agtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagcctacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattccattccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcattcagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacggtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaacac

SEQ ID NO: 288 - DNA, 2034 bp, Homo sapiens
ttaagccccgcatgcgttatgtatttgtcctaatgctctcactcccctttcctccaccaagtcttaacatattttgttgtacaaatattacagtgtttgatgacaggctattgggtgttttgttgttgttgttgttttgttttgttttgtgagacggagtctcgctctgtcgcccaggctggagtgcagtcatctgatctcggctcactgcaacctccacctcccgggttcaagcgattcttctgcctcagcctcctgtgtagctgggactgcgggtgcccatcaccacacctggctaatttttgtattttttagtagagacaggatttaaccacgttggttagcctgctttcgaactcctgacctcgtaatctgcctgccttggcctcccaaagtgctgggattggaggcatgagtcaccgcgcccggcccttttttttgagatggagtctcactttgtcacccaggctggagtgcagtggtgtgatcttggctcactacaacctctgcctcccaggttcaagcgattctcctgcctcagcctcctgtgtagctgggaccaaaggcgtgcaccaccacgcctggctacttttcatatttttagtagagacagggtttcaccatgttggccagattgttcttcaacaccagacttcaagtgatctgcttgcctcggcctcccacagtgctgggatgacaggcgtgagccactgcgcctaacatgacagctgttactcagcatgtgggatgtttactgttctcacatctggaaaactctgaattctgaaacacatctggttccaacagtttcagctaagggactgtgggctgtgcctcttctgagtactgaaggaaaaggtcttgcatacagcaggcactcaataaatgttagctgagatcagcagtagtcccagcccctagacagacagacaaactgatggaccctctcctctgtctccctctccgtctccctctccgtctctggctctgtctgtctgtctctgtctgtttctctgactctctccctgagcgactctggaagtctgggcagggtgtgttctgggattgaagaccaggcgcatttcctcttctgtggccctcaccttaccctgtaccctcagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacggacacaggtctgatctgaggagactaggaagacatggctgtcccttgggggccattctgagggaatatggcccagtctggggcagtgtgagggttgggaggggccctgggaagcccctgaggttctctgccccctcccgtcatggctgcaaccccagctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactt

SEQ ID NO: 289 - DNA, 2816 bp, Homo sapiens
aagaggcgccaccgtctccaaggagtggtccggggcaccggtttcaaagtcgcagggcgggccgagtggacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaaggttgcacagtgaattaaaagatgctgttgaaaaaaaattggaggcctttccccttggcacagaggtaggaactgacatatatgcagatgatgaaacagtcagaaaccttcaagaacaattgcagctagccaatcaagaaaaaactcaggctgtggaactctggcagactgtttctcaggagttggacagactacacaagctttaccaggaacatatgactgaggcccagattcatgtatttgaaagtcaaaaacaaaaggatcagctatttgattttcaacaactgaccaaacaacttcatgttactaatgagaacatggaagtgactaaccaacagtttctgaaaacagtaactgaacaaagtgtgataatcgaacaactccgaaaaaaacttaggcaagccaaattagagctgagagttgctgtagcaaaagtggaagagttaactaatgtgactgaagatctgcagggacagatgaaaaagaaggagaaggatgtggtgtctgcccatggaagagaggaagcatcagataggcgtttacagcagttacagtctagtataaaacaattagaaataagattatgtgtgacaatccaagaagccaaccaattaagaaccgaaaatacacatctggaaaaacagaccagagagctacaagcaaagtgcaatgaattagaaaatgagagatatgaggctattgtaagagccagaaatagcatgcaactcttagaagaagctaaccttcaaaaaagtcaggctctacttgaggagaagcaaaaagaagaagacatagagaaaatgaaagagacagtttctcggtttgtacaagatgctaccataagaaccaagaaagaagttgcaaacaccaaaaaacaatgtaatatacaaatttctcgattaacagaagaactttcagcccttcaaatggagtgtgctgaaaaacaaggccaaattgaacgagtcattaaggaaaaaaaagcagtggaagaagaactagaaaagatttaccgtgaaggcagaggaaatgagtgtgattacagaaaactggaagaaatgcaccaaagattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctgttttgagggttattggaaaacagagcagtgaccacttcctgtaagtaaagaaaatataatcctatattgagcttcagtggagaataaaccagctgagaagaactcattgccttc

SEQ ID NO: 290 - DNA, 2212 bp, Homo sapiens
ttttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggccgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcccgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttcttttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttcctttttttttttaattaaataaatggatcaaattaaataattcaagccctgccttcaaaatgaaatttttttttagtattatttagcaaaaacaataaaacccaaatttttttaaccatc

SEQ ID NO: 291 - DNA, 3716 bp, Homo sapiens
agagcggccggaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctgtggctccccttcaggaaataaagcagaacctccacacatggaactcatccctgctggacctggagacgctgagcctacagagcagagctgccaggctgctcaaacgcagctccagcgatgccagcacttcctcattccccaccagctctgatggcctctctcccttctcggagaccttcatccctgactccagcaagggccttggccccagggcacccgcatccccggcaccagcccaggcccagacccccacccctgctccagccccagcctcctcccaagcaccccttcggccagaggatgacattctgtaccagtggcggcagcggcggaagcttgaacaggctcagggaagcaagggtgacagagcttgggtgccgcctctgacccctgccctccgcacgttggtgagccgagggagggaggagcctggggggagctggaggaggggctgggtctgagggggactgaggaccctccaccctctctctctgtctcagatctctcttatctgtctacagacctctcctgctccagtggagaccctcagttctctggggacccagcctaaccatgtcccactgtggagcagtgtggcccagcctggtccaccagaggccttctatgtggagaggcctccttttccctcagtgtcctctccacacatcttttgggcccccagctcccacgggttcttctgggccccacagtctgggccttgggtatcccttggggctgttcctcccacgcagcaggcctccaccctagcacatctgggctctaccctcgcgcccccggcttccctggcctccaccctcgaacccccggcctccaccccagctcccctggcctccacccttgcacccccagcctccaccccggctcccctggcctgtacccctgcacctccagcctccaccctcgcatccccagctgtcccccagggcctgcccatccctgacccaagcagctgtgcccagcctaagagcctggggcccaagtctcggaggagcagagcccctcgcccagaggctgccgagcaagtccctgcagctggccagggacctggccctcagctcaggggtgtcctgggccaggtagtggcagctcggctgttccctgacagcctggaggacacgcctcctcacttcgagggcccccctccacccaaggctggatctccgaaagtccaggccacacaaccccaaaccaaggtcactccccctccatctgaatcccagtgtcgggccaaggccgagtctctgaaagtcaaggccttgccgcccgcagcggggtcagtgatacggaagagcgaagccactccttcccctggagcctgcctgcagcccgaggtcccactctctccagctgagcaggcaaccacagtcaacgcctcgccgccagccttccaggtggggtctccggaggccctggccccgcccccgcccgctgctgaccacgccccctcggaggccctgcttgcccaggccgccctgctgctgcaggctgcagaagactccgacggcagcgagttccaggacgatcccgtgctgcaggtgctaagagcccatagggcagagctgagtcggcagaaaagggaagcggatgcccgattatcgttcctgttggaccaggctgaagacctgggatcttggtcccctccagccgggtcgccccctaggtccccaaggaggctgctaagaagggaaggagattccctggaggccagaagactttgaattgtacagattctattttacccagtgaggctctttttttttttttcatacagttactggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcatcaccatttctacccaagggtttaaaagacatctcaaattccataggtcctaaatggagtttccaatctttccccctaggcgtgcctctccccagcttctttttttttttttttttggatggagtctagctctgtcacccaggctggagtgccatagtgtgatctcggctcactgcaagcttcgcctcccgggttcacgccattctcctgcctcagcctcccgagtagctgggactacaggtgcccgccaccacggtcggctaattttttttgtatttttagtagagacggtgtttcactgtgttagccaggatggtcttggtctcctgacctcgtgatccacccgcctcggcctcccaaagtgctgggattgcaggcgtgagccaccgtgctgggccccccctccccaactttcttcggctctgtcctttgccgctcagaccaaaaaccttagagctgtctttgacttctgtctttcccttccacccacagttaaccaggaaatcctgccatctccgcctttattttattttattttttgagatggagtttcacccttgttgcccaggctgtagtacaatggcatgatctcggctcacggcaacctccacctcccgggttcaagcgattctcctgcctcagctactcgggaggctgaggcaagagaattgcttgaactcagaaggcagaggttgcagtggaaaaaaaaaaaaaaggtaatttctctctctttctctctctctctgacacttgctttagaggctacatt

SEQ ID NO: 292 - DNA, 2643 bp, Homo sapiens
caaacacaatttagtcatcgttagtaaaatgttttccttgcttggttaacatctgagtcactttggctgcaactttattttcatttttgagttttttttttttttttttgagactgtctcattcttttgcccaggctggagtgcagtggcacaatctcagttcactgcaacctccaccctgcaggttcaagcgagtctcctgcctcagcctcccaagtagctgagattacaggcacatgccaccacacctaactaatttttatgtttttagtagaaatggggttttaccatgttgtccaggctggtcttgaactcctgacctcaagtgatccacccacttcagcctcccaaaatgcttggattacaggcatgaaccactgcatctgacctccctatagtattctttaagaacagctataatgacattgcatattaaacatcatactctgacatctaatctgatttttaaaaattcatatactaatgtgccttaaaaatgtcacttcaagtctacttttctttttttctcttgttttgatgttatgggtaagcactagtaataaaaaatttaaaaatattgtggtatgacaacatatgtggcactcaaaatgctggtaactgcattactgcagtttttagtgtgccaagtagcagtgcaaaatgatgacagcaccacataagtctcctttgcatttgttcaactctgccattctaatgtgaaagcaatcatagacaatacctaaacgaatgagtgtggccatgttccaataaaatttcatgagcactgaaagttgaattttacataattttgatgtgttacaaaatactgctgtgttagccattagattttttcagccattagaaaatgtaaaactgttcttatgagctggctggatttggcttgtggaccaaatttgtgacccctattccagagtattttcgagtcagttaatccatgtttgcccattcctaattttataaaccacattcaaacctgttaattcgctgttatcatcctcattttgccatttagattttaaaatgaagagcagtgttttgttagaaaaaacaaaatgtttaccataacaagaaagatgtgtagacaagaaagatatttatgtagactctttgtttgttaaattttgaagccaggtgatgcattgttagctttgacaactgacttaaatttttgtataattatttatctttgcattttgctcaggtaaattatcttcccagagtctagaaataaagatatccctgatcctgtttaagagcataaataatactctcaatgtaaattgttttgaaataagatcttaaaaatacaaaatgtagacaattaatattcaggtgcttacttttgagccaatatgtagcagagaaaaactaatttctctgtggcagtatttttatttttggcatttcccaggaattaactgaagactaaaactcatatgtgaagtgtaatgatactaatcaaagagtcagtaaaatttccatttggctaccatgtatgtgtgtatatatttatgtatgtatgtgtgttacatatttgagacagggtctcactctattgccccaggctggagtgcagtggcatgatctcagcttactgcggcctcagtctcccaggctcaagcgatcctcccacctcggcctcccgagtacctgggactacagacaccaccacacctggctaatttttttattttttatagagacacagtctttccatgttgcctatgttggtcttgaactcctgggctcaaataattttcccaccttggcctcctgtagtgctgggattacgggcataagccactgtgtcaggccccatgtatgttaatagtgaatgtttggcttttcatttgttactttcagctattaaaggatacctattacagacacaggaatttacattttcaaagtcatttttgacacatcagtgctgcatctacttttctccttttagcacatttgatattgatacttcagagaaacttttttaactacccttaaaatcttgtcaatgaccattaactgccaatcatcacctcatttgctttttttgacaacatactactagaaacctaggctgtgagtgtaaaaccataactgttagaatcatttttttggcaatagctcacattctgttaagagtcatttgctttaatcaaagatcatgatttattatatattttttataagtagggatggggccaagattattcctttggcacagcagtaagtgtgctcaagatctttgcctgtaagcttgaatatttggcttaaattttgtgcatatgaatactgttaaaggtatatttgactacattttgaaaggaaaaaggtagtcctgctaaaattgacatttagggatattttaatctatgtatttggtaaagtaattagtgaagtattagttataaaaattttaaggaaaacatttaaaagcaaaatagtcgtatcagataaatagagtagaatacactaaagataaaacaagtctctgttacaaatgaagttgtctgtacagacgactgagatattttaattttatttacataaaaatgctgttcaatatctaatgatttctgttgtttgtattctgcactttagagtaataaaataagtttgagt

SEQ ID NO: 293 - DNA, 3101 bp, Homo sapiens
cggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcaggtgaaaaagcaaaacccaagattacagagcctactgcttctcagctggccttctctgaggaatcctctttccaggaacttctggcacagagatcctcaagagattccaggttggggcaagctagagatgaggaaaagctaataaaaattcaggaagggaacttgaggccaggaacaaacccccacaaagagatatgccctgagaagttgagttataaacatgatgatttggagccagatgatagtctgggcttaagggttttacaggaacgagtcactccacaagatgctctccatgagtgtgactctcaaggaccaggaaaagaccccatgactgatgcaaggaataacccttacacatgcacggaatgtgggaaagggtttagcaagaagtgggcccttgttcggcatcaacagattcatgctggagtgaagccctatgagtgcaatgagtgtgggaaagcctgtcgttatatggctgatgtcattcgacatatgaggcttcatactggggaaaaaccatacaagtgtattgagtgtgggaaagccttcaaacgcaggtttcacctcacggagcaccagcgtattcacaccggagataagccctatgagtgcaaagaatgtggcaaagcattcacccaccgctcttcttttatccagcataatatgactcacactcgagaaaaaccctttttatgcaaagaatgtgggaaagctttttactacagctcctcatttgctcaacatatgaggattcatactggaaagaaactctatgagtgcggtgaatgtggaaaggccttcacgcaccgctccacatttatccagcacaatgtgacccacacaggagaaaaaccatttttatgtaaagaatgtggaaaaaccttttgcctcaactcatccttcactcagcacatgaggattcacactggagagaaaccctatgagtgcggtgaatgtggaaaggcctttactcatcgctccactttcatccgacataagaggacccataccggagagaagccctttgagtgcaaagaatgtgggaaggccttttgtgacagctcttccttaattcaacatatgaggattcacactggtgagaagccttatgagtgcagtgaatgtggaaaggcttttacacaccactctgtttttattcgacataataggacccacagtggacaaaaacccttggagtgcaaagaatgtgcaaaagccttttactatagctcttccttcactcgacacatgaggattcacactggagagaagccctatgtttgtagagaatgtggaaaggcttttacccaacctgcaaattttgttcggcataataggatccacactggagaaaaaccttttgaatgcaaagaatgtgagaaagccttctgtgacaactttgctttaactcagcacatgagaactcacactggagagaaaccctttgaatgcaatgaatgtggaaagaccttcagccacagttcatcgttcactcaccatcgaaagattcataccagagtttaaaagatacaggaaggcctattacaagtgtgtttgtctttagtgaactcatagtggtgacatacctttccttttgagtataactattgagggaaatattttggccagagagatgtcttagtatctgataatttatactaactagaaacagaattgtccctgtgaaatctttttatggcaggtaatcacttgtcatccaaagaattatattaaagattcacccagtttagagccttacactgtacctgagaataatcgaggggagagacctggtggttaacatgcatttaggtaaaatgtcaggaacaactttcctcttattaatactataaatccatctcaagcatattttaaaataatgagagatggaggaaacaatctagaagataaaagaaaaagatgtgcataacttgttttcagtttccctgtttatgacagtttgtcatttggcgggttgggggatggagcagggaataagacattgaaaaagtctcatcccctttgtgtgttttacatatatatatctctaagtccagagccaggagagttggaccattgagggcagctctgccaacatttagtaaaagtattcattgttccaaaactgtcatctctacccttgagggagtgtgtctttgtgagaaatataaaggcttgagtcatgaaatacttaacacatgtgcacatgtacacatgtacatttatatgcagtgaattgttactcgtggtagttaggttctgtgaattttctgtgcacactgaattagtgaatgctgaatgattgttgctaggggaaatacagcgttagcttctgtgagcctctgatccaaacatttttatcaaccagtcaacacataaccttcttctatgggtatttgtttgtttgtttgtttaaagacactttatcagtgtttcttgaataattataattattctttataataaaaatattttaattatagc

SEQ ID NO: 294 - DNA, 2092 bp, Homo sapiens
ccaattttgctgtatttctctttagtataagcatattaaaagggaaaaaagcatgtactagcctgcactccgaagtcaagactttagtaaaattaggacgttggtcttgattaacttaattggattgctgaaatctctactgctgattggtaaaaacggcagttagttaattcagcactttcatattgttaaaggagtttgccgcaaaattctcactagcttttaacattttcagaattaataacagtaactttcaaactagaaaaatatctaatattcattgagttcacagatttcaaatatgtttatactgtaagaattagagcatttcattaaaaagttggtattctattggttatcaaattagtaaggaaacatagatcattgaaatattacaaaggcatcatttaatcagtaatttttactacatctcttccaaaaactagaaccagaagtcctgacacctgatttcccatcactagcaattttcctgattcacccacccaggagacaagatttgaatgagcagtaaaaatggccaaagatgagatgaccaaaaagacagtgataggtctcaaacacagccagagatcaatcaggtgctgctttgattctactagtggttcttaaataaaagtattatattttctacgtcagtggagcatacatacattgtcattggtcttctatgctaatatgtggagtgaattctacctttgaccttagaatgtatatagatatgatcaagtctttttagtcaactgtcatttgataaaaacaattaagatttagttaattgttgaattaaatggacttaagatattagataagtgggtaattcagagagtaatttttacattttatttagaaaaccttaagtactcaagttgaccaggaggcaccaagtggtataaatacagccagatgtaccagatattcctggagagccctacatttaaatattattctctttcattgtaccagcaattgtattaatatatgtcaaaccatttgaccagatttctagtacaaaaatacaatcatgctattttgaaatgaaaagggggctggatttggagccagggtccaggttgtagctctgccgcttgtgacttggtcaagtcagatacctctctgagcctcagtttccacacttctaaatgaaaaataaatcccagtgggtgatgctgcctgttgcgtcatccatgtcatgggttattgtgaggataaaacaatgccgtattctaaagcatttttgcagcagtaaaatggctctgtcttctacaggatacattctacttttaggggtaaattgcatggtattagttaattacatattcctaacggattgtgaactttctcatggttggcattcttgtcatgtcaaaataatgttttgccaggtattatcatcacatacaatagcatttctattggagcaaaataaaaagctcattttttaaagttggcgatacctcacatcctaattagcttcagctgaagataatttcagaaactttccaggcgctagttcccttgtattaggagggttgctgcagaggtgaaatagttgtatattccagtagctatgtttatttagttcacacattatatgcagtttatctttttttcatttaatcttagtgatagttgtgggtgtaggggtggattttgtttttgttttgttttgtttttaatttcagttctggccaggaatgatggatgaactctccgagttgagagaattctatgatccagatacagtggagctgatgaactggattaagtaagaggattttttttaacttttaaaattttaagtgccttttaagagtcactatagaccacatttcgttttgggggttttttgtttgtttctgaatctaattacgaagaaacattcgtccttactagatttttctttaaaactccatatttgaaaataatgtctttctatttaagaaatattctctccagctatatctcatgaagaaaggaaaatacccatttggagaggaaaaccgattcaataaataaatttcaaaccactgacagaaatggcaataaaagtttataatatctgttgaaactt

SEQ ID NO: 295 - DNA, 2087 bp, Homo sapiens
tttctccgggaaccgtgccgggagagcgcgcggtgctggagccgcaccgggtggccgaagcagaagactttccggaagctgctgggggatgtctgactagctctcatggagctccactaccttgctaagaagagcaaccaggcagacctctgtgatgccagggactggagttcaagagggctgcctggtgaccaggcagatacagcagccacaagagctgctctctgctgtcagaaacagtgtgcatccaccccaagagcaaccgagatggaagggtctaaacttagttcttctccagcatccccctcctcctctctgcaaaacagtactcttcagccagatgcctttccaccaggacttctccactcagggaacaaccaaataacagcggaacggaaagtctgtaactgctgcagccaggaattagaaacttcttttacctatgtggacaaaaacatcaacttggagcagcggaaccggagctcgccatcagcaaaagggcataatcaccctggggagcttggctgggaaaatccaaatgagtggtcccaagaggctgccatatctttgatatctgaagaggaggatgatacaagttcagaagccacgtcttcagggaagtctatagactatggtttcatcagcgccatcttgttcttggtcactgggatcctgctcgtgatcatctcttacatcgtcccacgggaagtgactgtggaccccaacactgtggcagcccgggagatggagcgcctggagaaggagagtgcgaggctgggggctcacctggaccgctgtgtgattgcggggctctgcctcctcacgctggggggcgtcatcctgtcctgcttgttaatgatgtccatgtggaagggggagctctatcgtcgaaacagatttgcctcttccaaagagtctgcaaaactctatggttctttcaacttcaggatgaaaaccagcacgaatgaaaacactctggaactgtccttggtagaggaagatgcgcttgctgtacagagttaattctggttgtgaatatcttgagagtctgccttggcattttataatatgaaaaaagttaatttataaaaattcacagtgcaatttatttgcctggcaagaaaagtttatttcacaaaccaacagccagtaagtgtttttgttctctatgtgtcttctatttagaagaaaagccatgtaagatgtataagaaaccacaaccagccacacctatccttctgaagagctgaaggctaattaatctgtaatggccaagaacttctacttcgatagaaaaatatttctaatgacccagtctacaaattatttcttttacacaaatatatgatgttattctttggacactaggtggtcctacacacagtaggatcaattgctaatctactttgtgaaaaagaactaagcactaatcaataataaggcttacatctaattctcaaaggtgcttatccattttcttgctaaattatccttcttgtaatttggctaaacactaaaacatggaatttttagtttgaatattttgaagtttgaggatgttgggctttccttattgtaaaaaatgttatgtttgaaattattcctgttttcaaaaatggtaattaagtcattaggataaactttctaataaaaaaaaattatgtaaatcattgtaagaccaatgtgaatttaaaccacagtgttggtgccagatattagccagggtcacaggctcttttttaaaatgaagtcaaattagttactgatataagttttatattttgtgattttgccatcatactggttatctgtgctcttgaagtctgctggttctcacaccagcagcaagaggcaaggcatgagacattttaaatatatttccagacatctaaacatctagacaggcctgagtcatgattggctctggtgtgcttccaggtaacatcttgttattgctgtttggggaaaaccaccaatagaattgcagctagacttttggggactgtgcctcgcaggctgtatcacttgctgtaggccaagcaacgagcacttccctcatggtagcaacagtccttaagcccaaagcc

SEQ ID NO: 296 - DNA, 2177 bp, Homo sapiens
cctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacctctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaaaaagtagcagcaactggccccacaactcctgtcattgtaagttattctgccaccacctaacaggacggagtggagtgagtttggataaacggaccgagctgggcttctcttcctccctacagaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttcctttgcccccaggaaaggacgcatccaccggtagcggccccagctgactgtcgccgtgtgctggggatctgaaatgaggcctgccagggcccctgtgtgctgtgctccagagccttcgctcccatcagggttggcatcatctgatggcatgtccaagtgtgcccagcagcggatgctgaagcaccagagctcaaggccttcacctgctctaggccagccctgtcaccacctccactgccatgaccaggccgaaggcagggaacgccctccccagtcccgctgtccagcaaggccccgagacttttcttctgtgatttccaaaagcaaggcagccgtgctgttctagttcctctccatccgccacctcccctcccgctgccccagaagtttctatcattccatggagaaagctgtgttccaatgaatcctacctcttgcccagtcccaggcagagtaagcagggcccacctagggaccaagaaagagtaggaagaaggggacgagccgggagcaaaaccacctcagacacccgggccttctcagccttctccccgtggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacattttt

SEQ ID NO: 297 - DNA, 2241 bp, Homo sapiens
gctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtgcgtgcgtgtgtgtgtgtgtgtgtgtgtgtgtgtgtgtgtgtgtggagctcgggtgccaagggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggttttctgtgaagaccctgattgatcggtcttgctttgagacaattgatgattcttctcctgaatttaacaattttgcagctattttggaacagattttaagccaccggctaaaagagatttcccaaagttgcagatggctggctcatctccaaatacctcttcaaggtcaagtaacctggtttggttatgaaagtcctcgtagcttctgggactatatcagagtggcttgccggaaagtttcacagaattgtatctgcagcattgaaaatatggaaaatgtcagttcttctagagctaagggtagagcctggatcagagtagcactcatggaaaaacatttatctgaatacatctctacagctctgagagacttcaaaacaaccaggagattttatgaagatggagcaattgtcttgggtgaagaagcaaatatgcttgctggcatgcttctaggactcaatgctattgatttcagtttctgcctaaagggagaggggctggatggcagttttcctgctgtaatagactatacaccatatttgaagtatatccaaagttctgatagtatcagcagtgatgaggaggagctaaggactttgggaagcagtggtagcgaaagcagtactccagagaatgtcggacctcctttcctcatggatgagaacagttggttcaacaagtgtaagagagttaaacaaaagtatcagcttaccctggaacagaagggttaccttgaagaactcttacgacttcgagagaaccaactatctgaatctgtctcccagaataaaatactacttcaaaggattgaagattccgatctggctcataaactggagaaggaacaattagaatatataattgtggagcttcaagatcagctgactgtgctaaagaataatgatttaagatcgagacaagagttaactgcccatctcaccaaccagtggccttctccaggagctctggatgtcaatgctgttgccttggatacgttgctttaccgaaaacacaataaacagtggtatgagaaaagttatcaaagtcttgaccagttatcagcagaagttagcctttctcagacttcactagatccaggccagtcacaagaaggagatggaaaacaagacacattaaatgtaatgagtgaaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttc

SEQ ID NO: 298 - DNA, 2457 bp, Homo sapiens
ctgttaggtatatcaattcatgtgtattgacaaatgcgtgcaccatgtaacagaaactcctttcaagatatagaatattcctatcactacaaatattaatcaccaaaacaatggggagaatgtctctagggcatgtcagagaccttcactgcagcctctcccattataggccaggaggccttgaaggaaaaaaatggtttagtgggccaggcctcaggcacccccccttgctctttgcagccttgaaacatggtaccctgcgtccccagctgcttcagcttcagctgtggctaaaaggggccaacatacagctcaggccattgtttcagagagtgcaatccccaagctttggcagcttacacatggtgttgggcttgcaggagcacagaagtcaagaattgaggtttgggaacctctgcctagatttcagaggatgtatggaaatgcctggatgtccagacagaagtctgctgcaggggtagagctctcagggagaacctctgctagggcagtgcagaagggaaatgtggggttggagctcccccacagagtcttcactggggcactgtatagtggagctctgagaagagggccatagtcctccagaccccagaatggtagatccaccaatagcttgcaccatgcacctggaaaagccactggcactcaacaccagcccatgaaaagagctgtgagggtggctgcatcctgcaaagccacaggggaagagctgcccaaggctgtgggagcccaccccttgcatcattgtgacctggatagatgtgagacatggagcctaaggagatcattttggaactttaagctttaacgactgccctattggattttggacttgcatgggcctatagcccctttgttttggccaacttctcccatttggaatgggtatttttactcaattcctgtacccccattgtatcttggaaataactaacttgctttagattttacaggcttataggtggaagggacttgctttgtctcagatgagactttggacttggacttctgggttaatgtttgaatgagttaatactttgggggactattggaagggcatgattgtgttttgaaatgtgagaacatgagatttgggaggaactagggtcagaatgatatggtttggttttgtgttcccacccaaatctctccttgaattgtaataatccccatgtgtcaggggtgggaccaggtggaggactgaatcatgggggtggtttccctcatgctattctcatgatagtgatttataacagatccaatggttttataagcatctggcatttcccctgctggcactcattctctctcctgccaccctgtgaagaggggccttccaccatgattgtaagtctcctgaggcctccgaagccatgcggaactgtgagtcagttaaaactctttcctttataaattacctagtcttgggtatttctttatggaagcatgagaatgaactaatgcacagggtaaaaatttaaaaacaaacatacaaatgcaagtaaacaagccaatatttcaactgttcccattgcattatccttattctttatctatggtaccaggaaataatacatctgaaacaatttttttttcctgccatgatgtacactcaagtgggtccactggggtttctttcagtttcccaaatactagatatgactcttccctataccttatcttcatatgaagaaagctatgagaatatattaataactgaatatagtaacactactataggaataagcatgtgtatattccaactgatcttttaaaacttttattttgaaatatttatagattcaaaggaagatgcaaagagtatagggaagtgctatatgccctttatctagttcctctagtggtatcaacttacataactgcagtatcatatataaaccaagaaattggcatctgtataatccacagacattactcagacttctctagttttacatacactaatttgtatgtgtgtgtgtgtgtgcgtgcacgtttatgtgtgtaggtctatgcaattttaccacatgtgtatatttgggtaaccactacaatgatcaagatatggaactgttccgtcaccactaagatcccttgtgctattcctttataaacatctccctgtcatcctttttcacccataaaagctagtaaacactaatctgttcttcatccttataattttattatttcagaattgttatataaatgtcatcatacagtatataacacatagagattggcttttgtcactcagcacaattcccttgagatgcatccaaactgttgtgtatatcagtaatgcaatatgtttaatttctgtgtagtattccatggtagagatgtgccatagtttaactattcacctgttgaacaacatttgtgttctttctacttttgggctattacaaataaagttgctatgaacattcatgt

SEQ ID NO: 299 - DNA, 2322 bp, Homo sapiens
agctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagagaatagcgtctcctagcagccagggcgtgcgtacgtgcgtgatgtcgtcagtgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtcccactgctgtaattagcagaaccaaactgtgatgtgcacatgtgtgttactgataagaccaggcctcccagctcttcttggtttccaatgcctgctaagtacatgaccttcttagggccattaaccagctttgctgtcttgcacttaatgacctttcctctttatcttccttgttgtgcaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatg

SEQ ID NO: 300 - DNA, 2176 bp, Homo sapiens
aactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccagggtaagtacccagcccactgaccccaaagggccctggctgcctcggggaggggggttgaggtctagctctgctctggagcccaccttgaggaaatctcaaggcagacggacagactggttgcttggtgcttcgccgatagtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaagtaaggttgggttttcccctgctggcctttggggaaagctctccccgctatgacagataggaggtgatgctgagtcagggttgcacccctctcggtggggtcaaggacagcgagcaactctggtcagtgggtctacaaggaatttctgcttgctttctacagggggcctctttccttggtccctcggtgtctcccagggccccatatccttagactatagggctggaggttgtaaaggggtgtggtgtggtggccaaaacttgttgagaggggccaggtttcaggatcagctggccaattcaaactgacctgggagcctgattgcagaaaacaagttcaccagagtaagaagagggtttgggaagacggagcagaacaagcagcgaagaggtattttaagtgggcagctggtgggcgggcagctataggggcctgggactgccaggcagaggaacaggaaggtaagcaaggagggctgtaggcgataaggcctcgcgtgctaggtcgtcttctttctctgaaggccactcagggtggacccatgcagcccactgtccaggccctggcaacgctgagtagcagccggtgggcctggaatacgctgagagccagctggcccctgatctccaggtgacagcctcagaacctgttactactctgcccacagacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgttgcctctggctttgtctttcctcagtgggcaggactgggtctgctggtccatctttacccttctctgagctatgcagccttggcctgctgcgtctccggcctgtattctctccccttcactcaggccctgggaaaccagcccagtttctggcaggagaggcagaggaggtcaatgcctttgctctgggcttcctgagcaccagcagtggtgtctctggagaagatgaagtagagcccttacacgatggagttgaagaggcagag

SEQ ID NO: 301 - DNA, 2719 bp, Homo sapiens
attgtctgaagcggcactggagacccaggaaaaatctcgctgaatccgcctgccccagcagcggcctgatctgggttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaaaacaattaccagatttcaggaaaccttactgtgccttggattacagggtgttctagaaaaagagcactacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactgaacatttaaaacaaaactttaaaaaattatttaactcattatttaatgagttctctgatttagtttttaacccctatgaaaatttgacttaaactaatgactgaaaattaaatgattacaggtatgtaattgt

SEQ ID NO: 302 - DNA, 1982 bp, Homo sapiens
aaaaaatccgcgccggggacagtcagggatgctcccaggcccttcgctcttgctttcagctagtcattgtcgagcgccgcccgtgacaggcgttttgccaagccctggagttactgaagtgaacaagtccctggtctctcgggacccattgccggttgaaacacatcccgcctcctcttccagtcctagaggccgcctcctccggaaagccggccttgattgctcctcatgtaggacgcggttccctcctctgagatcctgcagactctcaggtgctcacacgtgggtgtgcagcggattcagccggcagctctttaaagcggcaggcagatggaaattcgaggccagcccagccccggcgactgcgctgcggacggccagaggccatcctttgagaaacacccgtggattcttaccctgacctctgcataccctgagaaagaacgaacgtggcagcctgcgtctgcttgtctatgtctttcatgtttgctaacctaagggtcgagaagcggctcgaggagaccaggctgcacagaccgtcacgtccattccctctctggccccagccccgcgggaagaaaacgagggcgttcagcctggcagttcattcacttattaggaagaagacatcccacacccccacccagcacacacacagatgtcagggaccagccactaggaaccactccctgagcgaatgaaggcatccccgtagccacgtgcctggtacatcacaagcactcaaaacgtggctgccacctttcgaaattgcatgcccaaaactttatgagatcctcacaacacacttgggaaacagacaaaagagtttgaatgcccgcctacttaacagatacagaaaatggtgttccgtgtacaagcgacttactcatgtctgctggtaactcataatgtgccgtttgacctccttaggacataattaataatggtaattaacagtgctacgatatgccaggcattgagcttagcgccttaaaagtcatagctaactatgtttcacagcaaaccctcagaggcaaatgtgacccgcctcctacgcaggaggcaacagaggctcagacatgttaaagaagcttggcctgagtctcccagcagagaaagggcagagcgtgtagccctgacaacgtgcttaattgcaactcctgtgggtcccatcacaactctctcttcctatgtggtgtccgcaacattaatacatagagacaccgaggagcctcagttctgcttgtgggcgggcctgtctttcaccaggctggcaaaagcagtgcaaacatcattttggaggtgataaaataaaatctctcacagaggttggatgtcctttccgcctttcatggaagcacagtagatctgcagagtgttttatgcaagtagacttggtgccagtagtggaagtgtgtgcaggattctgttacccagctgtgctcaaaacagagcccaagtctctccgatggtcagcctggcacggcccccagatggtaacgagacgccagggacaatctgccagtggcaattttagaaagcaggtggtgctaggaagggcattctcttcagttccatgttttcaagttagaagtgcctcagagcatttacccccagctccttgagggggtgaggcagaggatcacttgagcccaggagtttgaggctgcagtgaactataatggcaccactgtactccacttgggcgacacagccagaactcctctttgaaaaacataataataaataaaaataataaatagtagtaataagagaccccttagaaaaaatcaactggctcttttatgaaaggaagatgctttcagaatgaatagctaatgcatgtggggtttaatacctaggtgatgggttgacaggagcagcaaaccaccatggcacacatttactacctatgtaacaaacctgcacatcctgcacatgtatcctggaacttaaaataaaattttaaaaaaagaagatgc

SEQ ID NO: 303 - DNA, 2185 bp, Homo sapiens
atgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacgccgtcacgccaaaggaagagaaagatcaactcacctgcagttaaaccatctaaagagaagaaagaccactggagacctagataacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaaacaaagtgaaatgcctggattcacattaaaacaatgggctctcgtttgctataatattttaaagctgtttaatcaacagtggagtctgctctataaatatagattatttgttcaataaactggctgagcttagagagaggtgcagaattcctggttctgagcaggtgcccagaaggtaccattaggtgccatgatccaggctgaaccaatatacagtggggctgaagtctgcaaggaggttgctggcttgggctgacctcactaatgccatcagcagcggtaggtaaattttttctccttgggtattacaagtttttgtctggagccaaccaagcttgccaccaacatattgagagtaatacactattgaaagttatcttggatggggagaaaaaaaaatagtggttttccttgtttgcaaaaacttccttcctattctcattttttcttaattttctttaatttagtccaagttccagttcttttaggccttctctttgatttattttcccctgcatgtgagaagcagttcagaaaaaggtctatatctccacctcctagtgagttagagtgttttctcagagcacctctgggtggcaaagggaagcatgttcctgccaaggtttgctgtggattcagaagcaccaggagcaagagaccagaaggatgatctgctcctttgtaacgttgttgagggccctcttgtttccaatgagcagcttataggttactcacagtccactttctcactggacacacaaagtggctctttatctacctttgcgggagattttcactctcctgcaaatgatcgttctcacactcatattagctcatgttggaatttcccatcctgccatgtcctttcccatttctttttggcttttttgcctccaccttttagcccacatcatttaactccactactgtgaaagcttgcttaaagaaaatccctcttggccgggtgtggtagcccacgcctctaatcccagcactttgggaggctgaggcggggagatcacaaggtcaggagatcgagaccagcctgaccaacatggtgaaaccctgtctctactaaaaatacaaaaattagctgggcgtgttggcacacacctgtaatcccagctactcaggaggctgaggcaggagaattactttaacctgcggggggagcctagattgcgctactgcactccagcctaggcaacagagggagactctgtctcatt

SEQ ID NO: 304 - DNA, 2486 bp, Homo sapiens
ggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggtgagtaatctagagagccaggggccgcctggggtccagcttgaggcctcctagctagcggaccgaacgtctgggctgtagctctagctagggatgggacttcttgcttcccggaatttgccggatggtctccctgggtctggccgctgattgcttgaagtcgcattgagctatgcggttgtcgcggcaagcataggtatgagcttgcttctgtcggggcggagacgctgacatctcttcgtcttggttttctgcagaaaggcctctggctggattccactcatctcggatacttaagcaaacaacaacaaaaaactctttagtgcatcagatttcaaagacttaccaaaaaaacaagtaggaataaggagactagtactgtatcccggaacctccaagtactcccagctttaacaattattccaactcttggcagttctttcacatctgtacctccatctacttccggtcggtttttgaaagctcacattatgtgttgatttttaaatgtgtgagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctgtaagcatccccttgccccaggcattcctgccagtttctggaatgagttgtaactggtatattttgtgtttatcttttttcaaatcataacttggaatgatcaaatggcttttttatggtggtctttttccagagaaagaaaagaaggttctaacaatctctgtaatacactttataactgacctggaaacttttaggagaaaatggattataaaatagtttcagtaaaaatcaaaggtgttttagattagttaaaggccatgcttttctgtgtaattaatgagaaagactgagcctataatgctaattgaaactacaggactttttactgtctttcttctttgaccctttcagttgttacatttttatctaaaattattttctgatattatgaaagaaattaataatgtatgtcttaccttaaagcacatttatgatctatagatatgtgctcatgtatctgaaaataaagttgtattttgataac

SEQ ID NO: 305 - DNA, 2648 bp, Homo sapiens
cattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttaccaaaaattatactgaatataatttaaccttggggaatccagaatacttagtattttcacatgaaactacaaatcatagactctgacactttgatttttaaagtactctgtccataaaagatttgtactgtttagatgggagaaacctctagagagagtaaaaatgaattacactgtatcttatatgaagtaaaaaaataaatcagaggtgagaatattgttactgcgggtatgagttgttgaattcctatcatttgtgatgattggttaacttcttttaggtaccctttttacccttttttagttcagaaataattctcccagctttataaatagtacactaaacatagtttaactttttttaatgactcattttttcattaaaagcataatgtaccatgttataatgccattagcagttacttaaatgctttaaaaattgctgattagttttcaatgtcagttggtttcaatttctagctctctctctctctctcctccccccctctcattttctggttcaatcttagtaaattaacattctggatttaattagtagttctaagttacacctggcctgagtttatgttaacatgtaaccctcaattggaaatttttggattctgggatggcagtactaaaatactttttatgtatcattgctaggttccagcctaattaagaacatagaaaattgacctctaattaagtggatcattattatggcatttcttaagctttatccaaatttcagctacataaaacatttcaggatttaaattagtaccatatcaattttctgtgatgatgtttaccaactataaagcactatgttggtttactacttcagtaaattattcttagtgaattattttctaaattaaaaaaaatgacttggcttttggtattgattaatagtattcacaacctgcatctgttaagatgtttgatctttaacccacacaatgtaagggtactgttgtcattgttctcaggtaggtgattctgccttccaagagtatatgtttctttaatcagtttaaaagataaaggcattttgggttttaagacccctgctttacatctcaggtaatgtgtagattgtacttctctggaaccaaatgtagttttctacactcagttgtaaatgttaatctttctcaaatgtgcacattctttaaaagtgtgttcctaagtagaaatatacctaaatgaagattctcttattttatcatataaatttatgcaacgataagttccaaatgtatttttcaaaacagaatggaatatcagagtacattttcatgaagtttaaaaatcaaggactgttcctgattagatgacgtatttattggtggccttcttatctaagcacatgagtagttggctctgaactttgtgtatttgaaaaaggaaaattcagtggaggcttttgtttgtgtgtgtgtggctttgaaaacaaattatttgagaaagaccataacacagtgagtagcctatatgtgcatttactgaattgttaatttaaggatatatattaatagagtatgtttaaaataaatattgttttcatcactg

SEQ ID NO: 306 - DNA, 2452 bp, Homo sapiens
gggacactgaggtaaaatcctattccctaggactagggactaggaagggagaaaataggaagctgctgtggcataggcatctgcatgggcagatggtgaggccaaagcccctgattttgccatacctcctgccctggtcaggactggttcaggcattagggcaggcccagccagggcagaagccttcctagatacacctgtggggagttgaggaactacagcagggctgaaaccctgctttcaggggcccccatgtggctggtaggggcagcttttggaagctagactggatcctattactccccagatgaaaagttcaaattccttaatacaactcagagctcatcacaatgtcacaaccctcctttctcggctcgcttcctccttaagagctctggggcgattctttcagaccagcctgagggatcttccacaggttgttaatagggctagaaacaaaaagtggtggtgtttctatgatctaatttgttggaacaaacgtagtgttaaactcaaacatttctgtaggatttcttggagctttaactatactaacatttactgtaactcttcaggacagggtatgattacgtatttcccacatttctttggtcagagaacccgtttttgtgaggagcatttcatgggacagctgttgtgagaaacagtttgggaagggctgtgttggtcccatggaggggctggctgttcccagagcaggtcactcccccacttgcattgccttgcctggactcttttcttggagggaggtccctttcctctacccatctgaatttttttttcttccaccagtgtccagcttgcctttcaccatgggcctaatgatggaaattacagttattttgtatcttcaaacagaaccaagcaaatcctctgagcttcattcatatgggaaattttctttctttcttttttttttttttgagatggaatttcgctcttgttgcccaggctggagtgcaatggctcaatctcggctcactgcaacctccacctcccaggttcaagagtttctcctgcctcagcaggaggattactgtaatcccaagtagctgggattacaggcctgcgccaccacgactagctaattttgtacttttagtagagatgcgatttcaccatgttggctaggctggtctcgaactcctgacctcaggtgatccaccctcctcagcctcccaaagtgctgggattacaggcatgagccacagtgccggacattatgggaaaattttttgagggactaaactaatctccacaaatagcaatgcatttaggaaatatatttaaaggggaaaaaaagactcatagtttcactcagtcatgttcataatttttagtatttgggttttttagcatgtaatttgtgtacatagttttggtttttgtaaacttgcataggggttttctggtacaaactggaaaacctgctagacaaattctgaaacatctgtaatgcttgtaggtagttgttgtaacactatgcccacacataatcactttccatattgctgcatagtctttgtaaccatttttcttcttcttttttttgagatggagttttgctcttgttgcccaggctggagtgcagtggcgcgatcttggcccactgcggcctctgcctcccgggttcaagctattctgctgccttagcctcccgagtggctgggattgcaggcacacgccaccacgcccggctggtttttgtatttttggtagagacggggtttcaccatgtcagccaggcttttcttgaacttctgatctcaagtgatcctcactcctcagcctcccaaattgctgggattacaggcgtgagccaccacgcccacctgtaaccattatttttaagattgctaccattggatagttctgtcatggtccaacttttggatatttaaaattgatccctgtgtggctaacagaattaatgtttccaaaaatgttgaaaattatatagttctcttaattccccacctctaactatatttttgggttatttctttaggaacagatgcccaggagtcatattactgagaatctagaaatcttttgcaaagttcttgttatattgccaaattgcttcccaaaagggttgttctaaaccataatttcaccagcaatgtaggggagaaccatttttatgctgcccttgtgagaattgggtatgaaaacatttttaaaatgatttttgatgaggtgaaaataatatttgaatatattttaatttgcctttcccccacttatagtgagcttaaacattttttccttttcctagctgtatttctccctttgttattcgttctttcgtccatttatctactggggagatggggagtgttatctttttagtttatcagttatttgcattttaaatataaccatttgccatattttaacaacgatttttccattaaataattctttttat

SEQ ID NO: 307 - DNA, 2161 bp, Homo sapiens
taaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagcaagttgaaaaacacatgaaatggctgatagatccactgccagtgaatgtaagagtaattgtttctgtgaatgtagaaacatgccctccagcatggaggttgtggcctacacttcatcttgatcccttaagtccaaaagatgcaaaatctattataattgcagaatgccactctgtagacattaaattgagtaaagagcaggagaagaagctagaacgacactgtcgttctgctacaacctgcaacgccctttatgtcacccttttcggcaaaatgatcgcgcgtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccag

SEQ ID NO: 308 - DNA, 2101 bp, Homo sapiens
acactctgggcccgagactcctcgctcctcctcgcctcgcctcgcctcgagtctctggctccgacctctctactcccttgtttctgacctgtgctccgtggtgtctctgatctccccctgccgccaggggaaaggaggaacatccctcccaggactcactcacacctattctccaactctgcctacctgctcaattcacctgatgctctgccagtggattgctgatgtctctacattgattcagatttgcacccacatctgaaaatggtcagcaggcagggaccctctgtcaccacaggtggaggaagaggagatgaaagagccttgtctgacaccctggagactgcaagaagacccttgccagatgtgggcccctccatcttggacttcccagctagcctccagaactggaaactacccagactgtgtcctctccctcttactctcctaaaggaagacaaggaagacaatgacaaatggcgtttgcagcaaagcaacaccaacagccaacttgatgctcaagagagaacgctatgcctcttcctcatggtttccagtgctctacacattctgagaaacttttctggtaataaactatagaaacaatgagactgtgcccatgggagagaccccatctctacaaaagatgcagaaattagccaggcgtagtggtgtgcacctggattccccagctacttggaaggctgagatgggaagatcgcttgagccccggaggttgagactgcagtgcgccatgatcgcgccactgtacttcagcctcagtgacagagcgaaagcctgtttcaaaaaaaaaaaaaagacagagagaaacgggctggggacggtggttcacgcctgtaatccccgcactttggaaggccgaggcgggtggatcacttgagatcgggagttcgagaccggcctggccgacgtggtgaaaccccgtctctactaaaaatacaaaaatgagcaaggcatggtggtggatgcctgtgatcccagctactcggaaggccgaggtgggagaatcgcttgaatcccaggagacggaggttgcagtgagccgagatcgcgccactgcactccagtttgggcaacagaatggggctccatctcaagaaacagaaaaagggaaatgatccctgaaagtacactcttttgttgtagtttttatttgcattttgctaacgattagtgatgttgagcaccttttcatgtgtttactggctatttgttttcttttttttgttttttttttggagcgatacctattcaagtcctttgttcatttttgggttgcttggtttttgttgttggtgttgagttttttaggagctgcctctatatcctggatatcaattccttatcagatatataacttgcaaatattttctcccattctgccaattaccttttgaatttgttgatattggtttttttgatgcacaaagttcttaagttttcatcaaagctaatttgtctattttgttgttattgttgcccccatctttggtgtcagatccaaaaaaattattgccaaatccagtgttgggaagcttttgccatatgttttcttctaagagttttaaaagtttaggtcttacatttaggtatttgatccattttgagttaatttttgtcgatagtgttaggtaagagtccaactttattctcttacatgtggatatccgttttttccagcactatttgtttaaaaaacaaaaatcaaacaaacaaaaacctgtcctttccccattaaatggtcttggcattcttgtcaaaaatcaggctggagtgcagtggcatgatctcggctcattgcaacctccaccttccagattctcttgcctcagcctcccaggtagctgagattacgggtgtgcaccaccacgcccggctaacttttttgtttttaacagagacggggtttcaccatgttggccaggctggtctcgaactcctgacctcaggtgatccacctgcctcagcctcccaatgtgctgggattacaggcatgagccaccgcacctggcctgatcaagtttaagactgcattgcaccacagcactgcagcctagacaacagagcaagaccctatgtc

SEQ ID NO: 309 - DNA, 2165 bp, Homo sapiens
atattgcattaaacacttgatgaaagaagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtatacatacatgaagagtggcttcaggactggatccattgctgtttacatgggcccattaaatggagttatgactattttctagtttatgaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacaggagagcaatggagacagagttgcttatccaagggcagtctagcaagtggcagagctggggcgtgagtccaggcagttttgttccagagtccgtgctcttggtcaccttactttgatgcgtatcctccaccagcacactttgagaaacaccacagtaaggaatacgcacacagatgtgacaactgcccctacaaagcatatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttattttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctccccgactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagc

SEQ ID NO: 310 - DNA, 3372 bp, Homo sapiens
tccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaagtcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaggttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagcgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctctttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatatt

SEQ ID NO: 311 - DNA, 2431 bp, Homo sapiens
atgaagaacgcgaggggatgggcagcggggagggaaggaaacccaccccgactccccattctcctacccccactccccatccctcccattcccccatcgcccccatccccattcccccccattcccaccccctggcctgtgccaagggggaggggaggcgtcgtccagggaacaaagggagggggaaggggcggcgcggggcgcggccgggcaggttggggggcaggtaggggccgcttccgcggggcgggaatcccgcgccccctccccccgagcctcaccttttatggtaaagcggcgcggggcggcggggcggagggagccgagggggcggggagggcggacgggcggaggggacgggaggcccagcggctccgggctccgctggctcgggcgtcggatcggagccgccggggcgcgggcggcccagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgttcccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctc

SEQ ID NO: 312 - DNA, 2443 bp, Homo sapiens
gattctcctgcctcagcctcccgggcgggtgggactacaggcacgcaccaccacacccggctaatttttgtatttttagtggagacggggtttcgccatgttggccaggttggtcacaaactcccagcctcaagtgacccacccaccttggcctcccaaagtgctgggattgtaggcatgagccaccacctccggcccatagtaatatttctattattaagactatgtaaacataatgttctttcattatgtttcctttcttattaacctttttgcctttcctggaacttgtaattgtattattttttcatctgctttgtttcctatatgcttaacactgttttttctccaagtgctcaatggatctggccaaaatctttcaacattttcaggctacttgtctgactcatttttatttcttcctggaaaactttccatccagagcactgcatccttctgctgtaataccaactggctgttccataggccagatgaatttctcttctcctgggacatctctctgtctcttccatagtaggttccctgtttcctccatctatgacttcctctttcttatcagtttcctttgctggagcataaccatgagaagtacattttttgagcccctgtatgagtctttagtttatagagttctatttccaaaagcatttttcctcagaattctgaaggcctttcttcacagtcttttagctttcagtgttgctagagagaagactttccatttctgatactttacatatttggcttacttttttctctttccagaagcttctagggtatgatatgtttggaagtgaatcttaatccattataccctttcaatctggagattgcgtcatttcgttcttggaaagttccatttcccctttctctgtcctttctttctggaactcttattgtcaaaaattggacatccttgatttagcttcaaattttcttatctttcactcctattttctatttttgtctttttatcctacttccttagactttatcttctacttcattgaatttttcattttggtgctcaaatttttaattttcaaggagacttgcttgttctgtccctttttcataacatcttgttctttcatggacctttaactaactctctaagaatactaaataccaatattaagcattaaaaaaggttgcttttttctcaacattatctttttttcattcatattctgtttcatgtttttcttgttgtttgcattgcctctctactaaatacaattaactgggtatggtggcacatgcctgtaatctcagcctctgtagtagctggggttacaggcacctgccaccatgcctggctaatttttgtatttttagtagagatggggtttcaccatgttggtcaggctgggcttgaactcctgacctcaggcgattcgcctgcctcggcctcccaaagtgctggattttcacgccaccgtaccaagctacctctctttcgtattagagcctttcttcaaatgcctgctgacctttggttgtccattcataaattgactaattagtccattaaaaagtcgactgaaagctctgtgtttgtggatgtggcttgttctctgagggatttcatagcaagatgattggttggggacctgatcatttcattaggaaacctccagatgtcattatctgtatgtattttagctagagctttcagcttctccagaggtaagtctgtatctgctgccagtgtcttggaaccaagttggtttagagatctgactccatgccaccagcaggttttcttcagtctctctgtgttcagtaaaatgcttcattgcttcctttgctgggcctggcacaccgaagtgtagagcctctctggttcaattttatgagaaaacaaacttcctgttccttatgatggtagaataagaatagttgctggctctatgagaggaaggtatgaatcagaggattgtataggcttatataggctttcaaagaatcttcctgttttctgctcattgcctcacctacactttgtacttccaattgctgaatttttccaggattctgtgggggtaaataggcttgcctcctttccgtgttcccctctgtaatcagtgaggttgtagctttctctgttaagtcaattacctcgactcttttttttcaactcccccaaattgttggaaacctttcattagctattgtctcctttcctgttctcttgatccttgttggattattccttttttattccttctccagcattttgtccctgtcagcacatcagagctaaacataagtcatcagtcaaaaggcagtctcagccaggtgcagtggctcatacctataatcccagactttgggaggccaaggcaggaggattgcttgaggccaggagttcgagacctggcttggcaacgtagcaagacccctgtctcaataaaacatt

SEQ ID NO: 313 - DNA, 2183 bp, Homo sapiens
actggtctaccggcgcggcgtagtggatgcagcatcctagtggaggacgcccctgtgggctgtgagacccagcgtcgcggctgctgggacagaccggggaggctgcccgtgccctcggctattcgggggctgttcttcagcttcttccggctcggcctcctcttctctcctcgctccttacacttgcagatctgccctccttggcactgtgcttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcgttcatctgcggcacgtgcgggaaggcgctcagctgccacagccggctgttcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagttgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaataccgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggagtgggtcgggacactgccgtgtttcaggttagcc

SEQ ID NO: 314 - DNA, 2002 bp, Homo sapiens
gcttgagttgtttgccggctcccgggccgccagacgctcggagggagcccggccggctcggactgggcggccgggagggagggcgccccgggtcacgacggcgcccgcaagccgagcgcggccgggacgtgcaccatggacccaaaggcgggcggcggcggcgaggaggacgactgcgtggactcgggcgccgagaccggagggtccgactacagccacctgtcctccacgagcagtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgataggaacaagatcctcctacaggcacaaagggtgcataagaagtttcctaaacctggcagagtacatcatgcctccgagaagaaacgtcattccactcctttgccgagcactgctgtaccaagccatacacctggcagcagccagcagtccccgctcaacagtcctcacccggggcccatccggacaggcctgcctcctgggcaccagcaggaatttgccggacgagccaacagcacccccaaccctccctggtctttccagagaagcaagtccttgttttgtttgcccacgggaggcccctccctggcctcctcagctgaaccacagtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgctcccccagctcccagcacctccaccctcacagactcctccccacagctcccatgcgatacccccaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtcat

SEQ ID NO: 315 - DNA, 2156 bp, Homo sapiens
acgtaagagggagagcaatggggacgggcagggacagagctgcgggctgaggttcctccgttcggcgaagccccttctctctgcccccgcctgctctgggctttcttggctatgtctgctcctgacaggagggatgtgtgttgccaggggtgggggcttggcgtgtgtgcgtgtgagaatatgtgtgtgtgtttaaaatacaaaaaaaaaaaaaaaaaagaagcgtgcctatactcagccgcgagacgctggccagcctccatccgtgccaactcccctccgagctggcactggggactccggaggcacggggaggaggaaggtgcgggcagcttgcggtgaggatggacgcgtgccaccgacgtatgccagcggctgcagggggccaaacgcctatccacaaaacccaccgcgatcgctggcagccgtggcgggaggcggcagcagttggcagaggtgccagggagggccggctggggcaggtggatcctggcagcagcagcgcaggggtcacgctccaggcctttctccaagccctccccgcgctgggacgcatttacccgcctgcctgttgacttcggctggcacccactcctgggctgctcagagctgctgctccctgttgatgagcactgtaggtggcttcgagatgcacgcctcgggacgatctgccttcctcccccgcctgccattcccgcactgacaaacgtctgccctgggtgttaggagcgaggtgcacattgcaccttacatcctcatgggcggctccaggagcctcactgcagctgatgagtacttaacaccatcatccatctgtgtggccgttggggctggcacagaagctctggatgcctctacctggaaaccagggctgttctccctggatggcaggaaggaagcaggtgggaggcgggcggaggtgcttgttccaccggcactcctgggttctgaggacatggcacttccccgcctgtgtcttgctttggccataggttctgagcttctgcttctcctctgtgggtacgagggccgctctggcattatgtcttctagacctgcgcctccttcagacgtcagggccgtgcactcagacacctccagtgaaagcttttggggtttggatggatggacagatggacaaattaacagcattctgcacttggaatgacaaaactttaggcaagaaaagggtcattggagaatatctagtccaacactctaatgggatagagagggaaactgaggccagcagaaagcatgtcacctgacccagtcacagcccttggatacagagggaaactggggccagcagaaaggatgtcactggacccagtcagcccttggatagagagggaaactgaggccagcagaaagtgtgtcaccagacccagtcagcccttggatagagagggaaactaacgccagcacaaaggatgtcaccggacccagtcagcccttggcctaggacctgcagacaggccacctgctgcttctgtgacccccacagcccagactcacacatcttcctccaggtcagggagtgaaggggtctgcagtcctctccaactgagggcagggacagtctctacgtcctgagaccccaggcccctgacctacctgccggcctgcctggcaagggcacacctatcaggttgcaccataaggccaccgggctgggtctgactcacccacaatccatcagcctgctggtctttacacattctgggagaggcaagaatctctgtagttgctaaaacacttcctcttggttattctgagaactaaaaacacacattatttgaaagtcttgggtttagtctaatctaaacccctcaggtcgtgacttaagctctggcctcagaggtctccatttatgcttggatgagccactcctttggtctttgtcccctcactggagggcatgtccatgaggaaatggggagaagaatatagagctatgaacttggaattttggtgtcagaaggacctaggttcaagttcaggctctatcactagctagggacctcactttcttcatctgtagactgacgataataatagtacatacctcaaaagagctgtgcagattcaaagtgatcctgtgtctaaacctttctgtatgatgtctggtaccaagtgaatgcccagaaaacggg

SEQ ID NO: 316 - DNA, 2416 bp, Homo sapiens
aaagtataattttactaaaagtcaaataaaacaggacactctagatgaaaaatacaacaaaataaggttgaaagagacccatgaatactggttccataaaagtagaagaaagaaaaagagaaaaaagttatgtcagcatcatcatatggagaaaaccaaagaatcagaaactcgctgcaaaatggaagcagagaatagttacactgaaaatgctgggaaatatctattggaaccaatttcagaaaagcagtatttagctgcagagcaattattagactcacatcagttacttgataaaaggcccaaatcagaatccatatccttaagtgacaatgaagaaatgtgtaaaacatggaatactgaatacaacacttatgatactatcagttctaaaaaccactgtaaaaagaacacaacaatacttttaaatggacaatcaaatgcaaaaatgatacattctgggaaacataatttaacatattctagaacttactgttgttggaaaaccaaaatgtcaagctgtagtcaggatcacagaagcttagttcttcaaaatgatatgaaacgcatgagtcagaatcaggctgttaaaagaggttacaattctgtcatgaatgaatcagaaagattctatcgaaaacgtagacaacattcacattcttattcttcagatgaaagtttaaatcgacagaatcatttaccagaagaatttttgaggccaccaagtacttcagttgctccctgcaagcctaaaaagaaacggaggcgaaaaagaggcagattccaccccggatttgaaactttagaactcaaagaaaatacagattatcccgtgaaagacaattcttccttaaatcctctggataggttaataagtgaagacaaaaaagagaaaatgaaaccacaagaagttgcaaaaatcgaaaggaactcagaacaaacaaaccaattaagaaacaaactgtctttccaccctaacaatctccttccttctgaaaccaatggtgaaactgagcatttagaaatggagaccacttctggtgaattgtcagatgtttccaatgatcccaccacatctgtctgtgtagctagtgccccaacaaaagaagcaattgacaataccctgcttgaacacaaagaaagaagtgagaatataaatcttaatgaaaagcaaattccttttcaggtgcctaatattgaaaggaactttagacagtcacagcctaaatcctatctttgccattatgaactggctgaggcccttccacaaggaaagatgaatgagacaccaactgagtggctgcgttataattcaggaatccttaacacacaaccaccattaccattcaaagaagcacatgtcagtggtcatacttttgtaacagctgagcaaatcctggctccattagctttaccagagcaagcattattgatcccactagaaaaccatgacaaattcaaaaatgtaccatgtgaggtctaccagcacattctgcagccaaacatgctggccaacaaggttaaatttacctttcctccagctgccctcccaccccctagcacacctgtgcagcctttgcctttgcagcagtccttatgttctacctctgtaaccactatccatcacactgttttgcagcagcacgctgcagctgctgcagctgcagctgcagccgcagctgcaggaacctttaaagtgcttcagccacaccaacagtttctttcccaaatcccagctctcaccagaacctcattacctcagctctcagtaggaccagtaggaccgaggctttgtcctgggaaccagccaacttttgttgctcctcctcagatgccaatcattccagcttccgttcttcatcctagccatctggctttcccatctttaccccatgcactctttccttcactgctttccccacaccctactgtcatccctttgcaacctctcttctagtcatcaccataatgggaaaaaaatactcttgtgaaaactattgctatatgcgttaagtgttcatctatgtgggtacatggctatttaactggtggaaataaactggccgatacatggcgtcattggtttgaaatcatttactgtaagtgcaatgatgcaaataaatccctaagtttctgatatataatattattaaagcactgaatagtttgaaaatcaatacaatatatgctatatattaaaatgatgtcttaagagtatgtataatgtacataaaatatatttatagtactctaatttatgttgtaaagtatgctcccttggtttttcttaatctttgtgtatttgcgcctatttaatgtttagacaaagctgatggcactatgttttgtatcatgttccttgaaactgtaaattcagtgaaaaatatctcttgcaataaatttttgttaactattt

SEQ ID NO: 317 - DNA, 2219 bp, Homo sapiens
agattggaggggcggctgcgcgaggctgcagactggtgcagcgcactgtgctggcggctgggcctcctccacctcctcgtctttctcccgggaaccttgacgacgccttccgcttggccctgccttctgccgcatccccgccgccgcggcgccttgaggagcaggagaagacgcagccgggccgccgccgttagaggggttcccggccgccgctcgccccgtcggccgccaccgcctccggggtcagccctctctctgggtctccgctttctcctgccgccagcgcccgctcatcgccgcgatggggctcctggactcggagccgggtagtgtcctaaacgtagtgtccacggcactcaacgacacggtagagttctaccgctggacctggtccatcgcagataagcgtgtggaaaattggcctctgatgcagtctccttggcctacactaagtataagcactctttatctcctgtttgtgtggctgggtccaaaatggatgaaggaccgagaaccttttcagatgcgtctagtgctcattatctataattttgggatggttttgcttaacctctttatcttcagagagttattcatgggatcatataatgcgggatatagctatatttgccagagtgtggattattctaataatgttcatgaagtcaggatagctgctgctctgtggtggtactttgtatctaaaggagttgagtatttggacacagtgttttttattctgagaaagaaaaacaaccaagtttctttccttcatgtgtatcatcactgtacgatgtttaccttgtggtggattggaattaagtgggttgcaggaggacaagcattttttggagcccagttgaattcctttatccatgtgattatgtactcatactatgggttaactgcatttggcccatggattcagaaatatctttggtggaaacgatacctgactatgttgcaactgattcaattccatgtgaccattgggcacacggcactgtctctttacactgactgccccttccccaaatggatgcactgggctctaattgcctatgcaatcagcttcatatttctctttcttaacttctacattcggacatacaaagagcctaagaaaccaaaagctggaaaaacagccatgaatggtatttcagcaaatggtgtgagcaaatcagaaaaacaactcatgatagaaaatggaaaaaagcagaaaaatggaaaagcaaaaggagattaaattgaactgggccttaactgttgttgacagtgaggaaaaactcccatatcatataaaatttcagggaaaacagaagcaaaggagagcttgggggtggggagaaaagacaaatgtgctctatgtcctagtaactcttagactgagtaaagtgttaataccatacccagatgttttatttatgaagtttttattttaaacattttttttaaaaattagccttgatattctccagaccaaagcaatcattaagtgactttggggattctccccctgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatc

SEQ ID NO: 318 - DNA, 2324 bp, Homo sapiens
gttttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacagtatatcccaagaatgtacacattctgcaccaattatggaggacaacagtatgtgattgatgctctgattggctagctctggaccacatgaccaactctgctctggtggtagagctaattccacttaaaccacatcaacagagaatgggtaagatgtgtttcctcaagggagactgtaacactattagaaggaggagtgaaagttggcgtgtaagaagcaaatgatcactactgatatgtgggcatttgaggtgaattaaatttttacttgaattattttatgttttcatactcatcagagtttgtataaactatggtaaaacttactgtcagctctcagcatgcttaactggtcttttactgtcatcatcatatgaagacaatatctgttatggtctgaatgtttgtgtccccttcaaattcacatgttgaaacctaaccatcattgtgctggtattaggaggtgagaccagtgggaagtgattaggtcacgagggcagaaccctcatgaatgggactagtacccttgtaaaaaaggccccagagagctgccttgccccttctagcatgcaaggacacagtgagaagacgccatctataaactaggaagcaagccctcaccagacaccaaatctgcgggcatcttgatcttgcactttgcagcctccagaactgtgagaaataaatttctgttgtttggaagccacccagtttatgatatttttaaatggcaagccaaatggactcagacaatacccaacatccaaataaagaactttataatttatcttcatttgctgctgctcatccctcttatttctttcatctgactttggtctccaggtaaaatgaacagaaaatgggcataaattgaggtatcctatgacaaatgcatttgctttttctatagaattacatcctaaaaaatttgaaaattcactttctcctacgactacctttttttttttttttttttttgaggcagagcaagactcggtctctatttttaaaaaaagaaagaaagaaaaattcactgccagttctacattgtggaggatactttgttttggcccctagagggagcgctagcctcctctataaatctcatcctcagcactctcctccagggttttcttacgctacattaaaagagaattgagaagaaactgttaaggtcaaaaacgtttcatgggcatgtttgtaggagcgtggatcaatccagtgagtgtggatcactgaaatcaatatgttgaatggatatctgtgctctcacgttcattacaacattcttcagaatcccaaatatacaatcaacctgtgttcatcaacagagatggatgaagaaaatgtggtatatatgaacaatagaatactattccacctaaacagggagaaattctgtcatttgtgataacgtggataaatctggaggacattatgctaagcgaaataagccaggtacagaaagacaaatacctctgacctcacttatatgtggaatctaaaaaagtcaaactcacaaaagtagaaactagaatgctgattaccagaggctagggaggtggagaaggaggaaattgggagatgttgatcacaaaatacaaagtttgaacaaaaaaaaaaaaaaagaaaaaatacaaaatttcgacagacaggaggaataggttttgagatctattgcactattaattatagtcaataataatgtattctatatttcaaaataactgagtaaatttcaaatgtatcaccataaaaatgataggtaagtgaggtgatggatatgttatttggcatgatttatcattccacaaaatgtacatatattgaaacatcgcattgtatcccataactgtatgtaattatgatatgtcaatgaaaaataatattactaataaaaattttaattttc

SEQ ID NO: 319 - DNA, 2187 bp, Homo sapiens
cagaggccagcctttatttatgtgtaattgaaacaaatggtcatgcgggaaaaactgtttttcaaatggaatattccaacagtctctatcctttcgtctctacttcaggagaccaatgtgatacttcagaaagaaaacccaaagggagcattttgtgaccctaagtttgtgggacaaattggatttttaaagttaaataaacccttttcatacttgctggactaatgtctggagaatgactatcttccactggtggtcagggaagaagggatggagaccgttaatgaggagacctggtcctccaggtgtcttagggttcattataacccaagtcttaatggacttcaccgagtccatgcccaagcctcttttgagcacccactatgtcccaggcactcccaccacagcccggtcactgagaggtttaggggtctcaccagaggtcaaaggcaaaaagcactccaggacgcccagctttctttgcagcagaagcaagaaatggggagtggcagcttcgtttccagggaagccaggagaggtgactctcatcacccagtcagcctccgtaattagtatgcgtggagtggaaagtaattaaatgctactcttggagaagagatacttgcgttcttgatggcgcctgattatttatttccttgagaggatgagagaatggtcgttagggtttctgtctgagcctgaggtttgctctcttcccttcatcagggaagggaagccaaggccactttgctcgctgggaaagtgctttggtttcttactaatgcctttcttctaaaagaacaatgagccaccttagcccacagcccagcagctctgcaccccgcccaagccctcatgcatattcatcctgcttcaaagagcacaacatggaatatgcaaattagccatgcaggagctggttggcattttgataacagctttgtctgaaaaaccccagagacacatgcacatctagtttctctctttctccctttctcttttctctacccctgtgtcctgcttctcactctcttccattcccagcctcccagagaacaggaaaatgaatcacagaaccaaagaagcaagttatggaggagcccggtgtctctattccagtccagtgtatttccacttctgcctctcctctctcctccttcaacagagtcgttttattttttcctaccaaagtgttgcctgatctgacaacatcccaaggtttccggcttgtcctatgctctccgttgactcccccgactcttgcctggggacccattctatgcctgtctctcagggattaacttccttccctttgtctttcttccatcttccaacctgttttgcccttactctcagcagtcaaggctaagaacctaagaacctagccttgccttccaagcaagaaaggaaaggaatcagctgcacagatcaggagagaaggtttggatatcagctgtcatcaccgacaggtcactgggactcaacatttcctgacacacaccaatttccaaaacacatctgcacaaccatcaccaacagtgccgacggcggtgctactgccccctcctttatcccagcagcagcgtctccttcatgagttgctttctaaccccctcccatagcagagctacttgaatagcatgaagaggattttcttaagttcagatgacgtgagtcccgctccttctccccgaaatgcagatggtcaagtcaggagctggtgggtgacagagtaggtgctctgctatgggagaagcaggctggggcttgaagcccacatccttagatgctgtttcatccaggaccttggaggagaaaggcataggcaggtgcagggatacaagcacctcttgggatttgaggacagagggggcctctctccttgactccaaaggccagcctgggtcagccaatgattggggaggcagcttatctcctaaaaggagcatgggctttgtgccttgagttcaaatccagctctagatacatattaagctaaataattttttagaaaattacttaatttctctgagccttggtttcctcatttaaaaaatgggaatactaatattaataatactagcaattctcccacagttgttttaaataatctttagtgtctagcatatatgctacgtgctcaatgaagtgtgacttttattttttcctagtaaactttgaaaagag

SEQ ID NO: 320 - DNA, 2892 bp, Homo sapiens
cctggcagcccctccctagcagacctgtgtgctccaggaacccttagaggagaaacactgccttctaaccctgagccctacttcccttaactagtcccagttgcagccacaaatctgtcttggctactaatgagtgactacgggatccgttcaccagagaacaatgattaaccttaaagcaattcttaaggaagaggatgactttactggatatcagggtagctatattattaatgtttggaggtttggagaactcaggctgtcaagaaaacaaatattaccattcatgaggacactgcattttaaacaatcaatcaggcttacaaaagaaagttacatttttataaaccatggagtgaagtggattcctgagttaaattctggggtacagtggcttcaagtgtctttagattgagtcaacaagggtctgtggatttaaattaacaggagacatgtatctagatgagatctttctcttttttttttgaaatgcggtctcgcggtcgccaggctggagtataatggcgcaatctcagctcactgcaacctccgtgtcctgggttcaggcgattctcctgtctcggcctcctgagtagctgggactacaggcatgcaccaccactcctggctgatttttgtatttttagtagagatggggtttcaccatattgtggtcaggctggtcttgaactcctgacctcaggtgatccctcccaaagtgctggatccactccacgtggccttgtctcattttaattaaaactgttttgccatagtaaaaataaaagggacaaatagaaaactcagccatcagcaagaaaaggcttcttccacaggggcaacattgtacattgctcttatcaatcactgaggaaggaggttggttactttctccatcttcagattcactagagcagttgtttctgtatgtgaatatgacatcgccagcagggtcctgtctttaaaaaaaattccgtaatctaaaattacttctcactggtttctgcatctgccacttggggaagccacctcatgaccaagtgtttcctacagccaccatggcccaaggctacctgtacaggatgcagcctcctgcagttgctcccactgtctcccaaatctggcgaacttttaggcaatggtaatggcaagtagccatggaattaattctgtgtggtaagaggcacacagacagatgatgagcagctcttctccttaaagaagtctgtgtctaattcctacgcgtggccgttgtcagagtatagctctttcccgttacctttactagccagaaacagcttgcttgctttctgaagaaagagaaatgacgcaccacagggtacatcagatgaatcagaaattacattgtttggacttcaaaacagtgtttactgactctgggcttaaacttctagtccactcctagaacagaaaccctcaaagttcaagagtggttttttttgtacaattgtttatacaaattcaacaaaggtaaaatcgcatcagggaaggtctaggaaacaccaccttacaacaatggcacttataaatgcagaactttacaactaggaaatagccatgttacaaacctaaatgagaactcaactcacacttcagaggagagaagcaaaagcaaaagaaaggctatgtgggagcatttattctacgtcttgactcactgtataaattagatctatgtaagtacaagagctcatgctggagcagaacctcctgagtgcaaaggctgaagtcgaaattttaaaatttgagaaaagtgaattctctacagaggaaacttggcagagtatcttactttgactataatttacatttatccacaacatgctcatgtaactcttgaggtacaaagcagactctcaacttccagttaaacatgcttttaagtggaaggtcttagcctactttgttagatctgggcacatttgtagatgggttgtgtcgatgaagtacacgttaaattctctcctaccttaaggaaatcaggaaaattggcaatctcaaaacaataaaaacactggtatgcattcaaaccttgcataaataactttcaaacaatttgtacaaaaatagttctgcataatgtaagatgtaacaaaaccaaccaaacaaaaaaaagtgtcaagacggcagcagatgtggtgtgtggtccactttatgtcaacacccaaaacctcggtgttgcaaggaatgaagtgtccaaaacaccactaccactaacagaaactcctaagctcatgcttcagtatgagaatttctccgaagtccaccctcctctccgacaggaatgtcttcttgtaaaggccgccttagaaatggtccagaaagcagtgcagttacgattcagaaagaccaaaggaaagtgtcggctcactcatcccccaaacgggtggttgaacagcttctcccttggaaagatttgcaaaatggaattgcgttgtggtctgttgtcccacgttccaaatggaaaataaaagccctcatttttgtaaagtctctcccctcccagagcccgccccgtatttacatacttatccttggactaactcagtttttgcaggagtttttcttctacttgcccaaactggacactcacagacatctcggctatgaactgctcacagccttccttggtgacttgcttgcagtacctcaggtcaatatgacagatgtttccacagcgtttgaagaaggacaggcactgatcagtgaccttattgcagtctgcagagaagaaatagtaatgtgaggtgtgaaggccaggagccagaagcccccccgccgccagacccaggcactcagcagtggggacaggtcagagctctacatattccagtccctgctgtgctgcactaaataaaatgttatttgctt

SEQ ID NO: 321 - DNA, 1281 bp, Homo sapiens
aaaaagaacaaaaggcttctgtgctgggcagcttgagttttccccaggctgctctattgttgcctgtagctgtgatttttcaggcaggctgctcctctgaggaccacccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctc

SEQ ID NO: 322 - DNA, 2184 bp, Homo sapiens
aagtggccgatgcccgtcgccagtgacaccgggacaacagctgcgggctctgtgcgagcggcccagcagcgcggagcctcagcggagtgagcgagcgcggggcagtagcggcctgcgattgtgagatggggactgagaacaaggaggtgattcccaaggaagaaatttctgaagaatctgagccacatgggtcattattagaaaaatttccaaaagtggtttaccaaggtcatgagtttggagcaggatgtgaagaagacatgttggagggacattcgagagagtccatggaagaggttatagagcagatgtctcctcaggagagagactttccatcagggttgatgatctttaagaaatcaccctcaagtgagaaagaccgggagaataatgagagtgagagaggctgcagtcccagcccaaatctggttacacatcagggagatacaacagagggagttagtgcatttgctacctctggccaaaacttcctagagattttagaatctaacaaaacacagagaagttctgtgggagaaaagcctcatacatgtaaagaatgtgggaaagcctttaatcagaactcacatctcatccagcatatgagagttcatagtggagaaaaaccctttgaatgtaaagaatgtggaaagacatttggaactaattcaagccttcgacggcacctgagaattcatgctggagaaaaaccctttgcttgtaatgaatgtggaaaggccttcattcagagttcacaccttattcaccatcatagaattcatactggagagagaccctataaatgtgaagaatgtggtaaagccttcagtcaaaattcagcccttattctacaccagagaatccatactggagagaaaccatatgaatgtaatgaatgtgggaagacctttagggttagttcacagcttattcagcatcagagaattcatactgaagaaagataccatgaatgcaatgagtgtggcaaagccttcaagcatagctcaggccttattagacaccagaaaattcatactggagaaaaaccatatctgtgtaatgaatgtgggaagggcttcgggcagagttctgagcttatccggcatcagagaattcatacaggggacaaaccctatgaatgtaatgaatgtgggaaaacttttggccagaactcagagattattagacatattagaattcatactggtgagaagccctatgtatgtaaggaatgtgggaaggccttcagggggaactcagaacttcttagacatgagagaattcacactggagagaaaccctatgaatgctttgagtgtggaaaggctttcaggcggacctctcaccttattgtccaccagagaattcatactggagagaaaccccatcaatgtaatgagtgtgcaagaaccttttgggataattctgagctgcttctccaccagaaaattcatattggagagaaaccttatgaatgtagcgagtgtgagaaaacatttagccagcattcccaacttatcatacatcagagaattcacactggagagaagccttatgagtgccaagaatgtcagaagacttttagtcggagctctcacctcctccgacatcaaagtgttcactgtatggagtaatctgcaaaataggaaagcttttagtggaaaagctaaagtccaacttattcatttgttcataatatgcaaatatgcaccccaagtattcaaatccaatgaatggacagaacctcctctgtcctcccactgattttaaatagttggttgaagaagatgaggcacttgtatcttattaggtacatatacgcaaatccttaacctcaattctctgtcctcttcatgtcttacccagatatctcaggaagatttctcttttccttctgtttgcctccctcttcgacttacttgggagtcagcatctgaccacagtcgtgactggtaatgatgatttgtgcaaatactatcaaggaaaggacatgaattgtcttaattttagacccattaaaaaaccgcacaggcctcaatcttaaaagtcctatctaaatacccagaaatacccttcagaatttttgaagctatgcccatgtacaaaattttcttccttccctaattttaatggtatactaacaccttaggtaaataaaatatttctttactattttattgatat

SEQ ID NO: 323 - DNA, 2113 bp, Homo sapiens
aatgatctagctcctgaagaaagaggctttcgttactgtccaagaagtgaagaccagtgagtctagcgataaagaaacaaaagagcccctgacagtatcgaaagaatctgacatttgctttgtctgtacaaaggatgaaaggaattttgccgacttagtcaaaacaataactggttttatatcattttgagtctaaaatacaggcatcagaatcgtatgtttttctttgtatttctgaagaattgtcatctttttaaaaacgtatgtggagtggttttgtttctggaaaggaaaacgtgacatggattttataagcttagtagctgtaggtggagactcttgttttgtttgctaaacctttttaataagcagcaaagtcaggatatcaaagattggaatttttcccccggaaccttttgttcttttcttagtacttcaaataatttcaaccaaaggggtatgcatggaaaatgaaaacaaatatgaagtctttccgctatttggcagtgcttcagatgagatgtatctatacttctgtgaagaaagacgtgattctgatatgaggcagtgattgtatacttacgctggacagagggataactggtttagtggaacagtgggttagtggtgtgctgaaaggattgtttgcctctttatccagcagtaagtaggcactagtagttgactgtctggggagtggcttttttttgtctgatatctattatggatgattccagtattctgagaaggagagggttacagaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccctatccctcctgaaggttgctggaaggcccagcacctccacacccaggcactaacagcactttctcccagcacttcgggactcacccccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatctttatgtcttttgcttgcttgttttccttcggtcaacccacatgtaactaggtcctgtgttgctgctgggaatatagtggtgaataaaacagtttccacc

SEQ ID NO: 324 - DNA, 3322 bp, Homo sapiens
atttttactagggagcagtttccccgcgcgacagttcgggagcgcgcaggcagtcgcgcgcacacacgcacgcaggcacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggcttccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgagtctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacacaacactgttagtaaggcaatttattggacacaatggcatcgatgatcttaaaaaaatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgtt

SEQ ID NO: 325 - DNA, 2770 bp, Homo sapiens
agtgacctcggggtcgttaggcctccacgtcctcgctggagctgcggacctcagtcgtccatccacacctcccccctgccgcccccgcccatctcaccctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtaggtgaccgtgacagagacaaaaccatggaagtgactgggtttggagtgaccaggtgttcctccctcccctttcccagacacgcctcttgctggcagatcctctgactctctggctgcggaacagtttcttccgtgctctggcctgagtgccacagccagggcctctgctctgtacacagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcaccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggccgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggt

SEQ ID NO: 326 - DNA, 2932 bp, Homo sapiens
tgtcaggggacaggctccgagtcagtcacagtgtgcagtcctgctgtggggacagagtgcagccattgttgggttagtacagtggcggggatgtgcctgccggcgtgatgatcaggcaggtcttgacacagcacagacctgagctgtgggactggccaggagagccaggctgcagctcaggtgtagggcgtcttgcagtgaattgcacttggagatcttccacctcttgtggaggggagacggcaggcggagccggggctaggcattcctgagacaggtggaggtgacagctttgcttgggacagaactgccagacaggattgcccatgtatctgccagccctggccccagcaggagccagttggatgactcatggcttccacctgcagttcacttcactgaagaaggctgccggcccaggccacgtggtaaatcccatgaggttctctctgcctgtgtgccccactgcaggggagggaggcagtgagtttgccatctgctgtgtgacattgtgagggtgcgcagagcagctgggggtagccctgatgcagttactgcattagatggacactgtgaagacgtgcagctatgtcatgggctcagcaagaagggcccctggcgtcacacagggcacccagccgcatcctgggcctagggtcaggggctcctacagctggaacctgcaccttctggggcacaaggtgccttctttgtggccaccacaccccatgtccagcccaggcctggacaatgatgagatgtgctcaggtgcttggtcagggctggctttggtggttggagaatcgtatcttcctagtgagttacaccattgctgggcctgctctgggctgccctcccagcatctgccttcatgatgaggcgtgacatgtgggctgtaacttgttgcctagcctcatggagaaactgtctttctgtaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactaggtgactgacgggagggctcctgaggacgggccccttgaagctgagcttcctgaggccagatttgggccagggatgggagaccctggggtaggaaagtcccgttgtggagatcatttggagattacctaaagtatttagaactcccgtgtcctgtgcctgccctgagcgaggcctgggggtgctgggagcagatgcaggcaggccccggcgtgttgggctgaagcaagtgtgtacactgccccgcagtgtcctgctgcgtccagggcccaggctggtgccctgcccttcccctctaagcaggggtttttgaccccgtgggctggtgctcctttctccctgggggcctgaggtcgaccaggaaaggcctgtgccccctccaagggcccctctcttctacccagtgccctgtgtgctgaccctcaatcaagatggcaccgtgtgggtgacagctgcgcaggctgtgcgtgcccttgccacaggacaggtgcgtggggtgtgggggtgagcccggggaggactgtactgctctgcaccctgccagggcacccgggttacagaggaaggggctgaggcccaggagtagggtgtgctcggctcacacagctggtgagggcagagtgccaccagccctgccctgggggctcctcccacagtgacaactgtgagaggatttccactctggtgtcaccaaccagccagttcctgctcgggccctgagaggctcagctgctgcccgggccccagaagcgaggacagaaaatggaaggggcatgaggacagtgctcaaagaggcagagggtcggggcccctgtgggccgagtatgcaggagctcccagggtgggcgcctggtgggtgtaggcctgaggaatctccaggggcaggtggtgggagggaacctggggtgagggaagcggaagcatcctctggctgccaccatgctccttcctgtcacagctccacattcccaaggggtgcagagacctgccagtcccttggagtcccaggagaggcccctgtgactgtcccactcagggagaggtaccctgaagaccctccctagtgaagccactgggtgccccaggcctctcctctcctgttcagcagcagcagcagcagcaaaaccctgctcccctgggagctcagtgcctggtgctccgagcacaggccaggccccataggggagcactctgcccctgcctgccctcggctggctccctgtggcacccctgatgccagggtctctcccctacagtttgctgtgttctacaagggggacgagtgcctgggcagcgggaagatcctgcggctggggccgtctgcctacacgctccagaagggccagcgcagagctggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccaaggggacctgcagagggggctgtcgggacagcgtggaataaacattatttcaagg

SEQ ID NO: 327 - DNA, 2906 bp, Homo sapiens
ctacctccaggaggaactcttgaggtgggcagaaaggcaatagattctagacgcattcacctctgtgggtaagcatagggactctgggcccagctgtaaacacaggggaacctgagttgaggggtgatgaagtgaccctaacctatccctgggctccccaggatgctgcgctctctgctttcagcccagggggtgtctcctcagatgataacagttttcattgacggctactatgaggtgagcaggacttggggggtgcctcgggtggagtacaacatggagcagcagtgattgccagggacgggcaagggagaccgcccaggcaagggctgtgaaatgtgaaggccttggattgcagaggtgggcagagggaaagtgacctcacatggtgagcagtggccatgtcccccaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtgcaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgtgagtgggaggcagggagcagggcacagtgtggcatgacagtcaagaacaagaacatggactctgaagcaatcttagctctgctacttgctagccatgtaaccttggggaaagagctatcctatttttgcctcagtttctttatctgaaaaatgaggataaagggctgggcgcggtggctcacgcctgtaatcccagcactttgggaggccgatgcgggtggatcacaaggtcaggagatcgagaccatcctggctaacatggtgaaaccccatctctactaaaaatacaaaaaattagccgggcctggtgatgggcgcctgtagtcccagctacttgggaggctgaggcaggagaatggcgtgaacccaggaggcgaagcttgctgtgagccaagatcacgccactgcactccagcctaggtgacagagcgagactccatctcaaaaaaaaagaggataaaatactactacctcactgggttacgatattttgaggtttaaatgagtcaatatatgtaaagtgctttgaattataaacatatataagggtcagctggtattgtttttatttttactatttttagcactagactgtgggtgtctggggagagtatttctgcctctaagtactggtccagccctgcaatctctgccctttcctgttttggcaagtgctggagcctatgcttcagcctgaggagaacagggaagtccttaggtaccgccaacccacctggctgcattcagaggaccattccccagttacagcaagggaggccttgagccagcccagcccaaaggaatgaatagcgtccagcttggaacctcctagaagccagaggtccctcagaggctgactaatacgcgagccccattcctctcccagagaggggcaggcgcttccctcaggtcactctcagtaccagagtcaaagtagtttattccttcccagcccagcccgtccctttgcccaccacctcctgcagggcctgtttctgacatctgtggctctagaacagcaggcccagggagaactacaagaggcagggactgctagttcatgggtctgtggtgcagtagtgtgagctgccgtgacagcatgagctctccagcaatggtggaggccaaattaaagctagtaagagcttgctgaggatgctgcaaagaggatggagaagacggtgggaaattagagggctctttacaggtctaggacttcatttgtgtgtcttatagatgtctggctggtcagcaagtgggtgtgggccagacaatgtgaggtgctgattttcactctcatacccactccaggaggcctacttcaagaagcacaagttcaacacggttccaggtgtccagctcaggaatgtggacaggttggggctggcagcagggcaaggggtggatatctaggagatttggaggccagtccctgaaagtcccttccaatgctgggcctgtgtgtttactccagccctgcggctacagattcccatgtgaccccttgccctgctcagtgctacccatgggacctgagggcctgcccactcccctgacccatttctccctcctcttcagtctgaagaaagaagcttatgaagtggaagttcataggctgctcaggtatggcctaggacaattggggtgtagcagggagcaaagagtcaaatactggggatcttggccccataatttacagggtcctgtgcaaaatgaaaatcagggccctcatctcaaacattaggaacttcaggccgggcgcggtggctcacgcctgtaatcccagcactttgggaggccgaggtgggtggatcatgaggtcaggagatcgagaccatcctggctaacacggtgaaaccctgtctctactaaaaatacaaaaaattagccgggcgtggtggcaggcgcctgtagtcccagctacttgggaggctgaggcaggagactccagcctgggcgacagagcaagactccatctc

SEQ ID NO: 328 - DNA, 2273 bp, Homo sapiens
tgatacagctattgtgattgctaggagaagggctttgggcagtgccagtctcctgtttgcagtaacacctgctctttctgaagagctacaccagtaacatggtgggttttcctcacaacttaaaagtctgatcgtaacacattcatggaaactagaaccagcacacgaaaccattggcttgtggccctaaagaaataactctgtgtccagaaaatgccatgttaccaggttgcctacagctttgcctgtaacatgggcacaggctgggacatcagatagaagctggttcccatggtggctgggttgggatgggctaagttatgttgcagtaacgtacaacctcatcattttagtggctagcatgacgaagttttatttctcatgctacatgtctactgtggctttcccggtggctcagggttctcagagcccctggcagatggaggctccaccctgtgggacgtcaccagttgttatggctggggaaggacacactggaggctcttgctgctctgagccacaggagacatttgtcatatctgcacacagcccactggccctgcggcatcctaccacctgcccagaaggaggagaaccagaattactgctgagcagctcctctgcatgtgggtgcaatggcgtcttatgactctcagaaagctactctagtggccatctaccagtgtcacacagtgtcacgctcggtcatggcctggaagatcagagtcacagagggataggacctggagtgtctctgaaaatagctgcctggtttcactccccggttttacgcctcttgagaagcagagtgatgcctagaatgagccctggactgggagggcacgtcccaggtttgaatcggggcctttgttccttttctgctgtatgactttggtcagatttctccttctgagaagtggagccaattaagcgatctccgatatgctgtaatctctgaaacatttcctcatatgtttctagcaacttccaacctgaggtctgatggacccagggttactttgcaagctaactgacatatcagtctcattgtctggtaaatctaattttaaccacttaatacttattttaggcttcacaaattattttaaaagaaaagataggggcataacaagaagaaagcttcggttacaatttccccgaaatgcctggatctgggattcctgcttcctggctgtgaggcagagaagatgaggatggccctggagtcagacgggactagggtccaagccccagctcttccacttgttaacaatgttctcagcctcagcttccttacctataccatggagacggcagtatttccttgtgggcttgttttaaggatccagtgacaggaagcatgcgaagctcttagaacagagcctggcactggtaaatagtcagtgagcagtagatgatattattaccatcctgtccctatccctgtcccccagcaaatattttggcttttaaatgttttaaatgatttcttgagaataagcaatgggtcagatgaaatctccttacctctcacctactggccatggcctaaatgtctgtagggagctggagccaggtgaggggagctgtggtttgggaagtgccgagttcattatgagcaagtgcacggtgctgggatgggctaggttccccgcacctcgccctgccactgcctcccaggacctgcctcttgctcccctgccacatagacagtctgcttgccccctgctttcagggacctcatggtccctgcccaatttaaagttcaaactctgcaactgcacaaagttgcaggcttggcagctgtgggacccgggcttcagagactccaggttcctcggcctgccccaggagggccctgctgaggtgaagtgggcataggagagagagtggacagagaatctgaatactgggtcacgttgcagttctgcgccttggatgccataggctccaggcccataagcccggcttcactaggcctgggtgtctgggttgtgaaatggggtgtctccttccaggattgccgtaaggacctggattcatccaagcttaaagtaaattgctttgtaaggtgggagacaccgagtacaggcgagggactttattaggtcagggatttaatcaggcatctgtttttacagatttctttattcctgttccctcccctccccttcctgtcctttcacaataaagaataacaacttgacacagcttagagactaaaaatcatccttcaataaagcagcagaagttgcaaagtttcctatgatgct

SEQ ID NO: 329 - DNA, 2827 bp, Homo sapiens
atagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaagtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattggctgggtgtggtgacgggcgcctataatcctagctactagggaggccaaggtgggagatcgcttgaacccaggaggtggaggttgtagtgagccaagactgcaccacggcacgctagcctgggtgacacagcaagactccatctc

SEQ ID NO: 330 - DNA, 2702 bp, Homo sapiens
tttgcacgtgctcttccctgcctggaatatccttcccggatattcccacctggaccacctctgaaccccagctcaagtctcacagcctccaggcagcttgccttgacttgcccagtccacgctcccctccggccccttcccactggatcatccccactgctcctggggtcaggagccaggtccttcacccctgtggccccagcatagtgctggcacatggttggagcccaaggctttattcagtggctcaaagaatgcaaaggaagggagtgtcgcactggacggggccttggcagacagggagctgggagacaggagtctatgccacctccactcctaacccccagtgccactatgaggatgtcttaaccgcctctctgagcctcagtttcctcctaaggttccaaaaggagacgattgctcctcacatccctctgacctgagggtccccaaatgattgccttcctggcatttcttctgggacctgggcagctgccctgcaggccccagccctcagtggccacgcccactgccactgagcccaccttggccttctggacacttgtcaaacaggctgagcaggaagcaggggctgctccagtcaagggcatgaggctggtgcctgggtcccattcaaactccagcagcggggcttggatcaggcagctttattccaaagggcagctgagctcacctcccagtgagggtctgggctgtgagggcccaggtggcaggcaggggtggggcaaggaccctggagtcaggacttccccaccttttggcttacagtggcagcaggcccacctggcagtctccagggctctgagggtcccctccgatgggagcaccttccattcccagatcccaagttagaccaggggcttccgaagctggaatctgctctctggaggcaaggctgcccaaacagcctctgtacagagtggggcgcacctcagacactcctcgggatgtagaaccagcattcttgctgctgagccactgccttgcattaggcagcagtggaggaaggggacggaggagagagaattgggaggcagaagggctgggtgtgggcctgggtcctcaggggacgtcttgacccccagctgctggcacttctccatcctcctgccatcactggagcagacatcagggacgagacaagatgccacctcctgccaccacagggcctgctctctcccccaccccccgccagaatacttgtccccctgcttggcagttgccctgggctctctgagtccaggaggtgggccctgctttgcaggggggcagttcctcaggtcaccacttgctggatccagctgatcacacctgtgatgcgggtgtagacgccgaagtagttaggccggccacagcccaggccccagctgaccagccccgccaggaaccagcggccactgagtgccttgcacaccagcggaccacctgagtcaccctgaaagggggaaaggagaaaggactgaagcagggtaagggcacccccttttccaggtgaagagccatagggattaagtcctgactgttgggaattgactgggtgccagagtcacgttcagtcttaaagctctgctttcccctcgcctgctaaatggagagagcccaagccagccctccccggcctccagccagcctgggacctcctggaactgtggctgtgtccccacgcccccgctctgcctccgcctcccttctgtggctgacacccctttcttcttccatgcatccacctcactgtgggaccctgggcctagtgccttgtggtgggcaaggagcagaactgggtttgagcctaacacctgcccatcacagcatctcttctgatctgtggctctgcaaccttgggcaagctcctcaacctttctaagccccagtctcctcttctgtaaagtaggggtggccatcaccaccttgctgggaggatgggaggcttcagcaggccgatgtgagcaaagggccagaccctggtgatgtgggcagcatcctttctccctcctctctccctcccatgcccgggggactcacctgacaggcatccttcttgcccttgcggtagccggcacacagcatgcgtggcgtcacctgatagcgataggcctcgctgcacaggtcctgtgggatcaactgcacatccactttctgcagagcgttgctgatggggcctgtccgtggtcaagggcagaagtgagatctcaggagcctggagcccctgttctctattctccctaacattattccctttgcatctcaggagcctacttctctcctgctctgcccacccttacccctgctagggtcgcacctgcccctctgcctccctgtcactttattctagctctttctctgtggggttcatggtgacagcccccgaccaaagcccatgtggagggccgggcacggtggctcatgcctgtaatcccagcactttgggaggctgaggcggacggaacacctgaggtcaagagtttgagaccagcttgaccaacatggagaaaccctgtctgtactaaaaatacaaaattagctgggtgtggtggcacatgcctgtaatcccagttactcaggaggctgaggcaggagaaccgcttgaacccgggaggagggggatccgagccgagatcgcgccattgcactccagcctgggcaacaagagcgaaactctgtctcaaaaaaacaaaaaaaag

SEQ ID NO: 331 - DNA, 2368 bp, Homo sapiens
caagcacacgccaccagggcctagggtcccaaccagagatccacacagattctcaatagccactcatctagaatctgcttaagcctgccgagctctcaggggaaggggtggccagcatctcagctgtggctgcctgttgtctaagtcatttgagcttcttgggggagggttggtagccaacactgggactgatagctgcctaacacactaagctcccagggcaggggaagggtggcagcaatctctatagctccaggccacgcttttcttctgctggagccagagaggctgaatggcttggtctcaagaggtatcccccatagcccaacatactggctgtggcagactgtggccagagtgcctcttcagacctgaacctgacccatccctccccactgggttgggcctccctgcaggaactccaagaactccagccaggggctcagggacagaactctgatctccctgggcttgagtccctagtgggaggtgtggccacagtctccagggaccagcgaattagtttttcctcctgatagttctgggcaatccaggcagaccagacgagtgattttcctttcagcaaagcacaccctgtccaccaagggacagtcaaagtgcttcattaaacaggacctgttccctatgccactcaacttggtaagaccctccaacaggagttctcagacaccctatacaggagtgttcctactggcatcagataggtgccccttgaggtcagagatcccagaggaaggaacagacacccatccttgctgttctccagcctcctcaagtgacatctccaggtgccggagtgaaccagatgaatagggcctgaagtgaacctccaggaaactgcagcagccttacagaagatggacctgaccattggaagaaaaacaaacaaacagaaaggaacaacagcagcatcaacaacaacaacaaaaaagtccccatagaaaccccatctgagggtcagcagccacaacgatagaaactagacaaagtcatgaatgtgagaaagaattaacaacaacaacaacaacaacaaaaagatgaaaatccagaaggccagagtgtccctggtcttccaaatgattgcagtgcctctccagcaagggcacagaactggacagaggatgagatggaggaattgacagaagtaggcttcagatgttgagtaataacaaactgctgagctaaaggagcacgttctaaccaaatacaaagaagataagaaccttgataaaaggttacaggagctgctaactagaataaccagtatagagagaaatataaatgacctgatgggggtgaaaaacacagcaggagaactttgtgaatcatacacaggtatcaatagccaaattgaccaagtggaagacaggatatcagattttgaagactgtcttgctgaaataaggcatgcagactagattaaataaaaaacaatgaaaaggaatgaacaaaacctctgagaaatatggaactatgtcaaaagactgaacctatgattgattggagtatgggaaagagatggttagaatggaaccaagttggaaaacacccttcaggatattatccaggtaaacttccccaacctagcaaggcagcccaacattcagattcaggaaatacagagaacaccactaagatacaccataagaagatcaactccaagacacaaaatcgtcagattccccaaggctgaaataaaataaaaaatgttaagggcagccagggagaaaaatcaggtcacctacaaagggaagcccatcagactaacagtggatctctcagcagaaaccctacaagccagaagagaatgggggccaatattcaacattcttaaagaaaagaattttcaatccagaattttatttccagccaaactaagcttcataagcaaaggagaaataaaaccctttcaaaagaagaaaatgctgagggattttgtcaccatcatacctgccttacaagagctcctgaaggaagcactcaatatggaaaggaaagacaagtaccagccactgcaaaaacacagcaaaatatgaagaccaaatgacactatgaagaaactgcaacagttaatgtccaaaataaccagatagcgtcatgatgacaggatcaaattcacatgtaacaatactatccttaaatgtaaatggactaaatgccccagttaaaagacaaagactgacaaattggataaagagtcaagactcatcagggtgctgtattcaggagacccatcttatgtgcaaagacacaaataggctcaaaataccaagcaaatggaaagcaaaaaaaaagcaggggttgaaatcctagtttctgacaaaacagactttaaaccaacaaagat

SEQ ID NO: 332 - DNA, 2291 bp, Homo sapiens
tagaagatgtttccctcagtgaagagtgggcaggcatttctcttcagatttctgaaaatgaaaactatgtagtaaatgccattatcaaaaatcaagatatcacagcatggcaaagcctgacacaggttcttaccccagaatcgtggaggaaagccaacataatgaccgagccccagaactctcagggaagatataagggaatttacatggaagagaaattgtacagacgtgctcagcatgatgacagcctcagttggacctcatgtgatcatcatgagtcccaagaatgtaaaggagaggaccctggtagacatcccagctgtgggaaaaacttgggtatgaaatcaacggttgaaaaacgtaatgcggcccatgtattaccacagcctttcccatgtaataactgtggggtggcctttgcagatgatacagatcctcatgtccatcacagcactcacctaggagaaaaatcttataaatgtgaccagtatggaaagaactttagtcagagccaagatcttatcgttcattgtaaaactcactctggcaagactccctatgaattccacgaatggcctatgggctgcaaacagagctcagaccttcccagatatcagaaagtctcctcaggagacaaaccctacaaatgtaaagaatgtggcaagggcttcaggcgcagctcttcccttcacaaccatcatcgagtccacacaggggagatgccctacaaatgcgatgaatgtgggaaagggtttggatttaggtcacttctttgtattcatcagggagtacacacagggaaaaagccctataaatgtgaagagtgtgggaagggctttgatcagagctccaaccttcttgtccatcagagagtccacactggagagaagccctacaaatgcagtgagtgtggcaagtgctttagttcaagctccgttcttcaagtccactggaggtttcacacaggggagaaaccatataggtgtggtgagtgtggaaagggcttcagccaatgtacacaccttcacattcaccagagagtccacacaggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccggaattcagatcttaatgttcacctcagagtccacacaggagagaggccctataagtgtaaggcatgtggtaagggcttcagtcgtaattcatacctccttgcccatcagagagtgcatatagatgagacacagtacacacactgtgagcgtggaaaggaccttctgactcatcaaagactacatgagcagagagaaacattataaatgtagtaagtcagggttcaattagtaaaacagaagccacactgtattccagatgatagaggcttactcagcctgtgggagggctaggggagcaaaagacagggacactgccatcgataatgtcagcctgcagcactgaagtgtgccaggcaaggactgtggatttcaagaacttctgtgaagctcccatcaactgctgtatgctacaatggcaaagaggttacttttgacaaatgggtggtttgtggtagtggttgtagttagtggtcaaatttccattaaagggtgtgtccaggaaggaaattctaattgggatgatcatggtaaggtcttcagttcagccaacgtctttagatttttttttagtccccagtagaaaaatactctctgtatgaagaacattcaaaagtgtgctcaaaaatgaaacccatgctcttactatgaaagaacgttagtacccaggttttccatgagattctctacacaggcaagaagctccatagaagtggcatttgaagggtgtggcagaggcagtgctgtgtttatcacactggttccatttccttgcaaataagaagtctatttcccagtaacccttgcagttaagagtgtgcccatgtgattgagttctagccaatggagtgtgagcaaaagtgatataagccactttcaggtctagcctttacaaacatcctcaggcttctctatccctgccaaggtgaccttggaggctgcttattccagactgggttgatagaaggtcactacttcatctgtgttggatttctttttagagtaagaaataaaagttcattgtgtctc

SEQ ID NO: 333 - DNA, 2937 bp, Homo sapiens
aaccttgtgtacttccgctgcaggagggcgaggcagccgtcatctatcccctctgggagttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaggaagacaagcttcggatgatggagacagaaatccaaggagatgggtgttcaggtgagaaccatggagctctgagtctttgcggggtacagcctagtcctctcctcctcaccacctcctcagccaccagcctggcccaagaccccagaattcatcgccctggtttactgcagcagcttgcacatgaccttcctccttctacctccctccagtccattctccacatagccagatcatgacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtggttccccctgtcaggtgtggacaggagaatctagtcaggtctctgaagatgagaactatgtaataaagctacaaggggagagttcaaatagcacaaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccacataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggggagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacacaggagagaagccatacaaatgtgagacatgtgggaagggctttagtcagagttcgcatctccaagaccatcagcaagtccatactggagagaatccctacaaatgtggtgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagtgaaaccctataaatgtggcatgtgtggtaagagcttcagtcagacttcacatcttcaagcccatcagagagtccatactggagagaaaccatacaaatgttttgtgtgtggtaagggctttagtaagagttcatatcttcagattcatcagagagtccatgatggtgatgaatctattaatcatgatgagtgtgataggggtgctcttcaagacttagacttcccattttcctcagaaaatccacacagcacagaatatttataaaatgtcatgttttaagaattcatgagctgagtttttatagttatctgaattccattgaagaaaacctatttttgtatgaatatgaccagtttcaagcagagcccaaaatgtcacagttgtcaagagaacacacaacagagaaaccctataaagaatgatacaatatgtttcaatcagaaccttcacatccaataagcaatatgcaggagtgaagccttcaaaatgataagtaaggtcagaatttagcaaaagtataatgagggacatgacaaaatctgtgtccactagaatctaagctccatgcaggaacattgtttactgctgcatgatcgtgaccttgaacaagtacctaagaaatagtggcttccctggaattgtttaacttgataggaaaaatctatcatatataggacatatatttgaatattttagtgagctcagccccaattcgtcattataattgtactgggaaaaggattcttgcaagaagccttaaaatgaattcaaggaaatgacatttaattaaaacacat

SEQ ID NO: 334 - DNA, 2241 bp, Homo sapiens
gtttgatccccagtttacagatgtgggccctgatgcccagacgctttgtaacttggccattgaagctctgtaacatcagtccaggtctacctgggggtacccgtgggacttctgtgctcccaccctgttgtctctggataagggcattgaggccagcaacgtggctgtgcttagaagggatggagtgtgacgtgggtgggtggagaaggagactggaggtcgctgtgggggtgaagggtgaggcctgcagtgagtgcagcagtgagtgtgtgtgcacagaggcgcaggccgtggtgttggaggctgtggctgggctctgcctccgggcctgtgctggcagcctctggtgggtgaggggctggtcagtgagctccagcccagtgcccagacagggctctattctaggggccactagacagtggagggagctgagcctttgccctgcctgatcctcttgaccctaaattaaacttctcctcgccagggccctgcccagcctgccgtcctctcccctcttctccccaagcccctgctaaggctcttgtggccacccccacctcctgcctcaggacctttcccgcctgtccttctgcctggaaggctccctgcattcctcctggggccattctgtcctcacactgaccggctgggttgctttcttctttctcttcctgttgcccagctgcagcgtcaatgctgcggggcagggagagttgcctgttttgttcactgcccctgccgccctggggctcagtgtgcagtagctgctcaagaaatgctgggggatgagatggactgtggacaggaggggaccagggttctcctttgggcgggccacaggaggtgatgagcagagggtgagagaggagagttgagccccacttcccctgaggcctttggacaaggccaggtgaggggttccagggctgcgtctgagcgaggagcccagtgaccaccccttctgtccccgacacatgtgcaggccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggtgagggcagaaaccccgcattctgagtctctgcacgcccatgcctagtactgccaggtgtgctgagccccgcagtccagtcaggggcgtcctgtgagaatcactgggggagccctgggcatgcaggggaggggttgaggccttagaggcgccctagaggcggcagctcagtctcccctcccttctctttcccgcaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagtcgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagt

SEQ ID NO: 335 - DNA, 2876 bp, Homo sapiens
ctttctttctttttgatggcactggagcagagagaaactaaagcaggaaaatgggaagtgattatctttgtgttttttaagatgaagctccactgaagctgctagatgggcagttacccaagcagcaaacaggagagtgaggggtgggaaatttacttacatgggaagtagggctgacactgaggagctactagggcttttctttccttatatttattttttttttgagacggagtctcactctgtcgccaggctggagtgcagtggcgtgatcttggctcactgcaatctccgtctcccgggttcaagcgattctcctctctcagcctcccaagtagctggaattacaggcacacaccaccaagcccagctaatttttgtatttttagtagagacggggtttcaccatgttggccaggatggtctccatctcttgaccttgtgatctgccggcctcagcctcccaatgtgctaggattacaggtgtgagccaccgcacccggccaactacggcttttctaaattgtgcaaggagaggttaaacttaggaggagatgcaaatcagattttaggagaattcagattcatagcacagagcagtggcagtaaagattcaaatgcccaggacaacgtggagcttttcagggagcatctttccattcatttagggagtatttattgagtacctagtatgtgtttagcactttgataagacttgaaaatgtcagttcaacaaaaatacacttggactgaactcaactccttttaagaaaaattgacatgcttctcaccaagcagaaggcctcagttgcagacagggaccaatacgttcctgatggtttctctccaactggctctgtctcctcagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatctcgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgttgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagt

SEQ ID NO: 336 - DNA, 2838 bp, Homo sapiens
ctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcagggtggatctatgacatcacgcaaaaatatgatttttccttctacatatgtggtttgctttacatgataggaatactctttttacttattcagccgtgcattcgaattatagaacaatccagaagaaaatacatggatggtgcacatgtttagtatcatgtaatgttccgtgtaggtttcattgtaatactcatgcctacctcgcatggttgctgtgaggcacctatgacaggacgtgggaaagcattttgtacggtaactggcactgtcatttgtaaatgccattgtcacagcctcatttgtaagcagcactgcctctctgtttggggagatgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgaccagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaatggaatgccattagtgtagatgtctgtgccacatctgacactggagtagtgataacaaatagcccatctctagactctcgtgttgttatatagaccattcatttgcctgagcgtggcacagttttaaaaatagttctcttgattgatttcatacagaagatgactgtgatccatgacatctaataatgccctttctttatctgagatgtctatttttctaagccaaacgtttttcagactgcagaatgttcttcccagatcatttgaaatttctggctgccttacttgtttacagatagtttaagactatttaaatttctactcacaatttgatcatcacacacacacaaatccttgaatatcattgccagtgtcttaggtcaaatttacctaaagtgaatacagcccattctcaattatccttcacaattagacgcaggaatgctactaggaattggaatcaaacaatgccaccccaagcgtaattttagccagcagtttcagttatactcaaccatgcccttctgagctgttaacaagtgattcaatggacaagttctctttttgttccatctccattatttcctgctctaatgtatagtgggagtggttgtgtaatgaaaggaccaccaaaataataaaaggcagctaatggaaaggagagacaaaagcatggttaatatatatacttaatattacctccaatgactcgggaattgcctgtaaattattatagacaatagattgcatgtcatactccatttggttcaacacaacaacctatgtgttatcattacagctttggctgctgttaaagaatccagctctctattttgataaagataatcttaaagctgaggcaatgctccctcctctatctctctctgtgtaatttaccatagaattaggatgattagattgaaacacatgttgtatgttttaaaaactacattgcttcattactttcattttccgacaacatcaaactaacaagaggcagtgttaaatattttaaatggtgctatagccaatgtatttgaatgcttgcactgctggttgtgtatcatcaatatgaactttttatccaatgactcaactctaattacatctaagttagacttgctcacgttcagtttgtacagttgtgtgttgacttactatgttttgaaagtggtgacttctaccgaatgagtggaagttcccattgtcaaaaaaaataaagacctgcttgcagtattcatgttgacaacagagtaaaagagaatactgtaaagaattactgcaaatatttcctgtttatgttatttgccgttgtttgaagatattataaagggttaattgtatatttatatcatgtgctttatcgttttcccctcatgtatccaagtaatttttatttacatacaactaaataaatgttgtcctctttg

SEQ ID NO: 337 - DNA, 3120 bp, Homo sapiens
tttgtatttctgaccacctcaatatccacagtactcagtccccatgctactctcaccatgtaaggaaagacacttgcttatctgtaggacggctttctcagaacacagcctaaaccgatgtctgctctgtacgatggtggacataccgctgtctaggaaggattaccaagtgacatggtcagcaacacaaccccgttcttgtagctcccttgaaatgattcctttctatgcatctatttgccatgtcgtgtcgtgtaggtttgtcgtgtgggtatatgtgtgccgtggtggtttgctgcacccatcaacccatcatctaggttttaagccctgcatgcattaggtatctttcccaatgttctccctccccttgccccctaccccctgataggccctgctctatgtcgcttccctccctgtgaccatgtgttctaatcgttcaactcccacttatgagtgagaacatgcggtgtttggttttctgttcctgtgttagtttgctgagaacgatggcttccagctccatccatgtccctacaaaggacatgatctcattcttttttttctttttccgagatggagtttttgctcttgttgcccgggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatggtagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttccaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccacaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgt

SEQ ID NO: 338 - DNA, 3345 bp, Homo sapiens
ttctcttacatattttattttaaaatgaaaaaaaaaataaggtcatggggaacgagtagaaggctgcttcctgctgcagttcccctcttgctccaagagtggggatggcccagctggggggacctgctccgggcctgggtgccgcagcctcacctagacacaagggcacaggctttgttctccagggatctgtccgacaccagcatccccccgggggctcagaccctgcacttttctgtctgctgctggggttgaggggacagcagatgggcagcgagggctggtggctgcccaggctggccatgcccaacaccagcaggtgaggcggaggccgagagggtgttgtggccgggtcacctgggcccatatggagctcactcctccctgtgggggccgcttggctgtgctgccggaggcatggcgctttccccacccgatggatggcggggcttcatccttcctccccttgcaggaggcacggtgcccagggtcctccgtttgtcccccctccttaggggaggtccccttttgtggtgtgacctctagtgggcatgtagggtcactgcagagggcttgcccccagccagcaatgtgaaacaaaatgccatttggatagtttccaaacctaccccggccccctccccattttgacttgaaaatccccaagtgacagaaggcacaatgcgtgtccttcctatctttgcctccgtccctcttcttcctgaggggtgcgatccctggcgccttcccttcttccttgtgtgccggcgtgggccctccctgccgtccctgaagcccacctgcactgcctctgagccgcggaggtcctggaagcaaggtggaaaggtgctggagggccagggggaggcgcccctgcagcgctgtccctccccagcaaacaagcagctgggctctgctgggtgttctccatggcaccgtgtttggcagacattaaccacggaacaaccaggagtgctggtgtggctgggatcagcccactccacaggagaggaagcagcagctcagagaggctgagtaatttgcccagggtcacacagccagggagtattagcccagggccccagccccgcagcctcacctctcctgaacatgctcctctaggaagagccgccgccggtgacgctcagtgtcagttgctctgggaccctttcaccgagtgtggggtggaatcagaagcgccagctcacacagcagtggggccagagcagtcccggctgaagctaggcgctgatgaacttggactggaaatcttaacttgggctcagccagagtgtattgcttataaaaccacgacttttcccttcccatatgaggacttctagtaccttgaattcggttctcatataaaaacacgagggtgctgttttacagaaacacagggaggctaagcctggcatgctgcggccacgtgggaataaaacttgggctcttgggactcacatttcaagcccggagccagctaaggcctctgacggcgcagcccccatgcccctcacaaatgtgggtagagctgggtcagcatctggcttccgcacccccatctgccgtgcgcccctgcctttccagcctgtggctcaccttgcccagccccacggcctgatgccctggctgcatctgccttggctggggctcctctgggcatctggagttgctgcttcctggctccttacaggatgtttacagaaactgcaggtctgcagaggacagacggctctgcccgcagggaggacaggcacctggtgccccttcccacacgtacctatgccactggccccaggtctggctgtcctgagctctccctgcctggctctgctgatgaacatgcccttgtcaaggagcagagtcggtggaaagaggcaatggacctacccaggttgtgaagatgcttctcagagtgaggcctgagaagcagcttccggccccagggccaagcagtaggaactgacaaagtacggagggtccacctgtgtgcacagccgagctgcaaacccagggtcgtcatgtgagagccctacccactgcctgaagggagaaaacggcttggctctaggagtcaggcctgcggcggggcccaggcagcccctcactggctgagacccttgcagtgttctcgacgctcaagccttgtacgctcgcctcagggcagggcatcacctcggcacagttggtgtttggggccgggtgagtcgtgcgccgggccgctccatgcgttgtgggaggttgagcagcatcctttgccccaacaatggatggcagtccctcctacctgtcagccaacaggcccagacaagccaggtgtcccccgggccactaggcgctaccgggttgtgacctgcacctcccatgcggcaaacagtgctaagcactgggcacgcggcagtgaacactgacggctctgaccccacacagaccacaacacatcatgtcccgggatacgtgctcttggggctgccccgatcacagacacatcaggaggcggtggactcccaggtgcagggagggtcagggctgaggtggaagtgggcaggggcggtcgtgtgctgcttggctcaggtgacacctggcctggcacctggtgggtgaggaggggctagtgagatgctgtgtcctcagctgtcttcctctccacctgggagacacataattcccagaaacctcagcaggggctgactcctcactggccagagccagccccacgccacccaggaaccaactctggcccagggaaaggggtttccgtgaggcttgagtctgtcgtggctcccctgcagttctggggctaccttccccgggcacattccacccagttcctgagcaaagcaaagaggcaatggccagtgggccaccgtctgccatgcaggccagtcggtttgctcccatggattgggtgggtgtgaagcttggcgtcaccaggaagctgttgggagagatgcacaccccagttcccgcacgctgagatgtggcctggggagggggtttgagcatttgtagtttccaaggcccccagagcagctgtcctgtggctgtcatctgccgccactgcactaaacaaagcacctccgtttcaacatctctggggaagaggattccagagaacacacttcaggaaaatgcacacttttacatgcccagctagcagtcctttgccctttagtgagaaagggttgagctgtccttctttttccttccttttaaaaagcatttgggctggagcagtgcctcacgcctgtaatcccagcattttgggaggccgaggcagggggatcacttgaggtcaggagtttaagaccagcctggccaacatggtgaagctctgtctctacc

SEQ ID NO: 339 - DNA, 2209 bp, Homo sapiens
acagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctggggaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagcgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtgccagagcctgggtgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctcctccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggccccccacttccccccaaggggccctgcccaccaccaccttcccggtgacccagatgaccacatttaataccaaatggggtggggggaggcgcccctccagtgccaggggcacgtgctgtgagcttcctgggagcccaggttgtgctcactgctctcccgtatcgtgagcaccacctctgctttccctgcgtagatctaggccaggggctgcttgtttttgtggagccgtgtgtgttcttctctgagcagctcctccccggaggaccccagcgcagtcccgggagatggcggaaagaaggcaccagggcacagtggacactcatcccgtgacagcgatggtgaccatgactgtgggagagagaacaggacccgggatggagtggggctgtctgagtttccccagtgaactttgtgctttggcgttccacccctgttgttacttgttactgagtttcctagacctggggtgggtgttcccccaggaggaggggggtcccgacctgtgtcctgtggtggccatttgcagcttctgtgttgtgattcccttctcttcaacggtttcagtacatatctctcttcaataaatttcattcagtgttcc

SEQ ID NO: 340 - DNA, 3023 bp, Homo sapiens
agtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcgagaagcaactgagtttaaatacatacacgtattaacaaaacaaatgcaaagcctctacatacaacactgacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgtaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaatttttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgttcatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttactgccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatactt

SEQ ID NO: 341 - DNA, 2319 bp, Homo sapiens
agaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacctcagcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactggccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcaggggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgtgtacaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacaccttaatccacaatttgctctgctctcctctttgcagaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggc

SEQ ID NO: 342 - DNA, 2684 bp, Homo sapiens
ttttaatgggtttagattgggtgtccctccatcttgcctcaagtgggcaattctggaatggtctaccatgaacttgagaggtcgttttttcttggtagttcaaattctgtgaggctggaagtctcagagaagcattttgattgaacactgcgtgcaggaatgcagcttcatcccattagcattttcctcatggaagagtcctgcagtgaagttagctcttgaaggccagagggaaatttgctccagagcagaggcaatacttgcctgttagccacaagaagcttccccttgcaacaaaggcaggctgggcagccagggcaggtggtttctggaccccgcagatagagacctagtctatccatgctcccagaacccctttcatttcctctaaattgagggtgtgaatgtctgcagtcctcctctgctgaccatcatctttgctgagctacagttctctgacgtggtaaccgccttggtcctcttttcatccccagctcaaaacactaatactttcatggtacactggagcattaagagcctgagttaaggcttttagcacacaattaaatgcagcatgtggtattattgtattatctgagatttaatcgtaagcatgagagactctaagggcgctttcgtagctttggtttcccatgatggggttttctatgaaaggtttattgattctgcttccccttgggaggtgtttggccagaagctagtgctgaacaccaaagatcctaaaagccccacagaccccccatccagcctggctcttggggacagagatggttaagcagtccagcttttgcctccaaaatgtgcagcatggggcagggcagtgtgagggctatgatgcggaatgatggctgtttgctttgggatcctggcagatgctggatctctttacagatgggagcgaaagaggcccacacttaatgtacaggcattctgatgatgtcagtcagataaattcctaagataagctgtgatcatgtagctaagagctggcaaataatgagcatgcagccatgctgttctcacctttgtgacaggatcttctgggagttttttctgaagtccattcagggaatatattctcttctgtgctgtgtgacttgtgggatgtggatgttctgattttgcttgttttgacctctgtttaaaagggacttttttcagggcaggcttctttggagggcttgaggggtagggggcaatcaacatctccggtcatggaaagtttgcctgtttgagattatactcaatgtcttatggtctctttgtctctgcccctgccctaggtgcagctgaatgccggccagctgcagtatatccgcttagcccagcctgtatcaggcactcaagttgtgcagggacagatccagacacttgccaccaatgctcaacaggtatgtgccccagagacacaaggcctgtgttggagaccaggagcagatggcttctgacaggaaaggagcgctcagcacacagctgtcttgccacctcatccttcaaccagaagcaccacccccacaccctccatatccttctgcacccaagaggcatgggtggtaattggaacattagattcaaagtgttttctcttaccatcttgttctcaaggggcaaagaaatgcaagtcaggggaagcctcgaaggtgcctgaaagaaaccttacaggtgtgcacacccatcagacctgggaaatgttcgacagatcgcctgatcgtcaggctgtttccatctttaaacccaagtggctgttgtgttctggcacctcctgtgctctttggaaagcttacttagattttacccctacctcctcttgcatccctaaccagaaaaattgcccttctcctctcctctcgtgccctacaatattgatggctatgagtcacagatggtgagggggctgcctccctgggcttgggggtgttgagggacatgggtattacttgcagaagatggggggtgctggtcaaggggaggcattgttaatggattcttttgcctcagacccaaaaaaagcagcgatcgtttaagagctggacccgtctggcccagctgcatttctggtgatgtatctattgacagtggtgacagagctgagtttgtagagcaggtctccaaagatctcatttgggaaaatacgaggaatgagccaaaagcaaggcttctgagttccatatagtctctgggatcattaagggctgtttctgtgcccactccccggcttacctaaggactcggcttttccgtaactgatactgactcacacccttcccccagcccctctttttaacctcataagattcttccctgggatccaaaaaacataacggcatgggagtgggaggaaatgagaaggaagcttcttggttcctcagaagtcagtttggggctgggcacagtgggtcacgcctgtaatcccagcactttgggagggaggctgaggcaggtgatcacgtgaggtcgggagtttgagaccagcctggccaacatggcaaaaccgtttccactaaaaatacaaaattagctgggcgtggtggtgcatgcctgtcatcccagctacttgggaggctgagacacaagaatcacttgaacccaggaggtggaggttgcagtgagctgagattgtgccactgcactccagcctgggcgacagagtgagactctgtctc

SEQ ID NO: 343 - DNA, 2591 bp, Homo sapiens
ctctgggtctgcgtcctcttctcacagggacagcagtcgttgactctccctgatccaggagggtctctccagatccttccctaacagcagaggcccggctcgtggggagggactgggactcaaggcttcttcaccagcctgaggttggtgctggggctcggcggcggctgtgagaatcctgtgctggagaaagcgtctctcggccggcttgtctggggcgtctgtgcctctcctggatgggtctcagtttggccccgtccatccatcccaggagctgcggtggagcagacagggaggggtgccccaggaaccacagccccgtcactcctgtcttcctttaagtgaaccggtcatgtagatggaggttgttcagaaagggataagatgggacggcagctgggcctcatcccgcagtgagcgcgacgcagaggctgctgggcttgtggcaggggcttcggccagggcagagtcgggcctcacgtgcagggggctgagtgtgggcctcaacactggacttggccactgactgcagtgagccccaagatggggcaggaggtggtgtttctgtcctggagacccagggtggcttgggtccttgggatgtgtggggacctcggggtgagggcccgttggggccgggtgggcacggcaggagagcgggggccacacacccagaggcagtgccgtgtcccggctgggagggttcctgggaagctctgctcagccccagtctcagtcatttctagaaactgtgttttcctccctgtgacgtcacacgtgaaggaaacggaaaagggcagtgagtccttcgccccgcggcgccgtgcgcacgtcagccttcagggtgattccgctcctccagaggggcaggcgcgggtgtggggggtggggcccaggcccatcctgaggggtcccaggcatgaggggctctgagctgtgtcctggggtggtctgggccatggggaggttctggatcatgtcttgagaggtctgggctgtgtggggggtccaggccatgtcctgggggtctgggctgtgtctgtggggagtcagggccatccatgtattgggggtctggggcaggggggggtccaggctgtcttggggagtccgggctgtgtggaggggtccaagttatgcctttggggatcaggcctgtgggaggctctgggttatgtcttggcgggggtccaggctgtgtcttaggggctgggccatgttctggggacgtgtgaatcctggagggtggggccccggtctcgcgggtggctgtgtccctcgagttcaggcagcacctctcggaactttctggatttgcgtgctggcgtctgtcggcctcgatacccacaggctgcgcccctctcagcacaggaaatcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctgggtgaggctgggtccagcctggccggcacgccaggacccaggaccgactggcaggggccgggcatcgtcgggaggtcggggcaggtcctgcgggagccccagcctgggtgtgggctgacccattcccgtctcgcagaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgttgcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaat

SEQ ID NO: 344 - DNA, 2042 bp, Homo sapiens
tttttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgttgctctgtccccggctgtccccatccgcgccgctacgcttgctcccgcacaggccaggcactctgtagtcttcagtgctaccgcatcaacctgcagatgcggctgggggggcccgagggtcctggatccccccttttggctaccttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccatttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagct

SEQ ID NO: 345 - DNA, 3988 bp, Homo sapiens
agaggcgtactcggcggcggcggagcgggcggcagagcagggcggcggcgactcgcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagacggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacatctataacgataaaaaattcctaattgtttgtggtagtattttaattctagatgtgttatctctctgggaagtatagtttatagaaacacaaaatatttgatttcctgtgtcggctcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcgtactccttttctgtttggatttatatccctctaatgttctcctttaatttcacatgaaaaaaaaatctcctgtatttttttcagttagtgggagagcagcagaaatagatagatgtgctgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcttaatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctgtacatcagagcttagttcgaatggaatcatgaaaatctctgattctgacctcctaaggaaaaatgaaacccagaggatgtggtcatacaggatggctcccatgtgggcctagaacccaggatgcttcactcttgactccatgctcttccttttataccatgtggctgtgaatacatactatgggatgggattcaacccttctaagtaaatcctcagtctggtctatgttgttacttgcctgtttccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcgaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggatttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatg

SEQ ID NO: 346 - DNA, 2607 bp, Homo sapiens
tctactagagtcatagatgacaagtcccagtccttaacttggtaggatgaatacagatcacagcataggaagactggggtaccctcaggccaagggcgagcacggatcactgagttggggatggccatcaggagcaaagggccattgccgcccttgaccaaagaagcactgtggcatttggtaggcattgaatccatcccagccagccagctgcaacggagcaggaacctcatgtcggggacgattatacttggaatcaagagtagagaaatcaatatccttatcctccaaaagaggaaatttggtcttttgaatcacaagggacatgcttctctcttcttctacaacatgaggcacagtattgtcaaaagcaatgaaccgtttgttgacaagggtctctagcccctgtaattcctgccgcccttttccaaggtagacaaatctgggtacaaatactgtttcaaacataaagaagaagctaggaaggaagggtttagggacttcttgtatttcatctgcattttttaggatacgcaggtgaaccagctgagctggagggagcagctttaagcaagatactatgtagatacgctggttgaaagtcaacaacaggtcacttcgattactggcaaagcagagtggtccaaaatgcagggctgagtcgaactcggttacaagtctaccgtggaagtcccagatccggactgagccatcaatgccacctgtgacaaaaagtttcaggggaaggcagacatcaaatgaagtgatgtcacactcatgcaggcattttgtctctctccacacaaagctctgttttgattctgaagatgtcagaaagccttcatagtgccagagacaccagcagtagctttcagtgatggcacccacagaacctggcaagagtatcacacgttttagggggcagccacagaggattttgctgacaggctgaaggactaccttgttcacctgaagcacggcctctgtcaagtgtatgatgttatccgtgccataggaacagagcaaggcgtttccctgagggccttccagggtagacaatgccaatactgccccagagtgaacagtcttctctattcgggcacaactatagtgggaaagggttctcacaatgccactctcatgcccacagaacatcaatcctcctaggcctttttgcagatgggacctcccataggccaagcatcttactgtatccttacggtctgctgaagtgcacacaagatacttggctgtacaaggagagcgtgttgcatcaaacaccagcacctctgaactgcctattgccacaaagagttcctctctctctgagtcataggcccaagccaaagccttatccataacaagtagaggccaagtgataaccaggagatcccctgttactggagacaagaagcgcaataaaccatcctcagtggcacatagaatccgagtccagttatggccgcagcagacccgctgcacttgctggggagcagaaccacagacattgaagaggctataaaagtagggcaggtgatgcaatgaaaaactgtaggtggtctggcagaaaaaagtggtattatcaataaactgcagtctctgaagatcctcgtcaatattcagctgccgcagcaagttcccataagtgagattccattccctcactatgccttcactgcctgctgttagtaaggtgtggatctctggccggctatggatacatatcactgatgaggaatgggcttgaaagctgtggaggaagttaccttggtctaaaccccaagcgtggatctctccagccctgtttccagcatagaaattgccctgagagacacaagtaaaggagcaagtgatggaagagccactggcgacaggagtgaacttcacttcttccagctggccctgaccccggtgaatgaagaccctcactgtatcctcacacagagccaacagggatccctgggggccattcagggaaaatccctgtacaagctcatgatcagccataggtactatttgagccatctcgatgcccatgccatttggtaagataaaccaggtaaccacagcccccagggtaccagagagcagcaactcagcttctggatcatagaagaggcagctggtggagaaatgacagggcactgtacccagaaatctgaacgttcgacggtgatctccaaaaagcctcaggcgcatgtcaccacagtaagcaattaacatgtggtaggaacctgtgtggaccattgcttgaatgggcggccactgatccatcatgcgaagcctcatcttctctaccattcctttcatttctgtaccctttttttgtatccaaagtactgcctagaagaggatgagagatgaaagcctgactgtggaggtggatcattttccaaagtgtggggtagggaaggctgaatattcagatccctgttccctctggtgtgactaaggaaagactagacagcttgactttaggaatctcctagtacagcagctcccacttacccatggtttccctttctgtggtttcaactacctgtgtggtcaactgcagtccaaaaatatcaaaagaaaaattccagaaataaacaattcataagtttt

SEQ ID NO: 347 - DNA, 2524 bp, Homo sapiens
aggcgcgccggggccgtcccagtacgtcgccctgtttacgctggctctttctcccagtcttttttcgttttaagatgtgagaagagatgggattcttcaatcaaggccacaagcgggaaatcagtctgcaggaccgatgccagcaggctcacgcaccgagaacggctactccgcccagctgagaagcgcggggccctgacgcgggcgcgctcctcgcattcttccgttgggctgggaggctggagggcaggcggcggcggccgcgcatgcgccgggagcggccggagctgcgggacgcggagggccgactgcgcctgcgcgctggttgcctggttacggcgtggccgcgggcaccgagcggcgccggaagttggtcgatggctgccgccagtccctggccagcgtcctggggtttccccgacgcatcctctactgtcccttcgctctgcacagaggcccgggcagggaggggcggcccggccaccgcgcggagccgggtgtccgccgactcgcaagggggacgcgcgggctcctcgtccccaagctccgccctgcgcctttgctgcgccgggccctcccaggcccaccctggccccagccctgctgtcctcccggggaggtgcggcctactcggttcgttcccccggccgccagccccacaggggcgctggggtcccagccttggctgagtgcacgtcggtggcgagtgggcccgggcgctcgggcggccagagcgacccagcggaggggtgaggcgggtaggcgctcctgtgcctgccacggccaggccaggcagcatccacgccctcccgcggaagatcgcagggaacaggtgggcactatcctctgtgccctcatttttcggaggagccgagggaggctgagcggttgaggaagcggccagccatgccgggcccactcacctgcacacctgcctggcaagggcagggaagagccgcggccttcctctgctgctccttccagagggcaggcgccgtggtgggggtgcccgcccgatggcatcgcgggaggctgagctcccagcagcggctgaggtcctccctgggtgggagccacccttgtccccagctgggccggcggctggtgagggagggggtgatatccgtgccacgccagcagggccgcaggcggtgcagggagagcttcagtccggctgacgtggcaccagggccaatctgctcagctaacatttgcctttcaggagtcagattcctgacctgtttgaacagagttagggagcacgtggtagggcccagccccagccccgctgcccccatctgcttcttcccagtggtcgaggcgctctgcaccctccgcggaaggaggtgtcattgtttgccctttccaaagagggggatgcagaggtggatgctgcctctcaggcgtggggctcgccttttgccgctcgcgagttcaaagaacccaagagccaggagcccagggctcgaccctctagggtcctccgaaaccctgtggtcccaccggggtgggcactaagctatgggagagaccatagctgcagaaaccaaccctgccctaggcataaaatgcaaggtctctggacctcagggcagggatgttagacagcggcttctgttggctcctaggggtgtgaatcaccacatcgcctgcagggggcgcggctgtctttcttccccctcttctccctaatcctgagtgcacggagacagctctcagcagtttgtagcctgatgtggagtggagggttcctgcaccctacacccgagcccatccagcctctgggccatagacccttccgttgaaggcccagcctgcccctgagacgctgtgtgccctttttcaacttccttagtctctgagcatcaggtcttcatctctaagatagagcaagatgagcacctaaacgtttcagggctgaaatggggttgccaggacaacaagcatggcaggggcgaatggggacatcaggtgactgactgcgagccagcagaggcctccacccagtgctgggaggtgtcccgccggtggtggccatcactattcctggtggggctttgctgcttttgcctgcagcatccgctggtttctccattctccaagtctctgcccctgctcacacctggaggctggacacaagtgtcaccacttccctgaacccccctaggtgggctggaatcagcatctggtgcaaagctctgtgaccactgctgtaccacattatgcagagcacacaggacaggctggtgcacctccaggctgtgccaggaaacccgctgcctttgcgtcaccacagccttggtcacagcgtgaccttggtgcctccgacgggtcagctcctcccattagccatgctgtccagcacgggggccgctggtgcttgctgtgagactgagctgggctctgagtgtaaactacatggtaggttgtgaaggatgcaaatatcgaatcaatcattttttattgcatattaaaatgacaatatcttggatgtatcagattaaacaaaatactatttaatttt

SEQ ID NO: 348 - DNA, 3368 bp, Homo sapiens
aacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacagggagtaaactctgtctcccccggtctggtctcgggctgatgagcatgttgtggttcctgcacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctgacttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacgggagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggccctcaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccccgctccatcggcactaacgccccgcttcattggcactttgctgctgcctcctgagcactgccttccatgaacagggacagaccagaggccgtgcaaggactccccctcagacctccaaagggcaacagaagagtattaataaacgtgaaaacttac

SEQ ID NO: 349 - DNA, 2675 bp, Homo sapiens
caattcctgtgagagaatgaattagagaatcaagtgtatctgagtttctttggcttctggctcctctgagtgggggcactacacatcatctgagaaacacccccaaatcagggcacacttggtataaattccattgaatcatgactctgaagagatcctggccatggtgaaaactgagggcagaaaatgcatcagccagtcatcatccaggcagcccatccctcacccatctttctgctactcaggacatcatgctgggccccacgggacatggccaaggaaacacagtctctccctgtagcttgtcctaacaacaggacagccacgcacccagctcccatgggcgagggcccaggagccctcagactcctccctcacacatcagtctccaagcctcgagggaataaatgaagtaatgaaataaggtagctatcacatgtcacacagtacaactcgagagttttaagtgatcaacacatgttagagtttaataatgataagtgaggccgggtgcagtggctcacgcctgtaatcccagcactttgggaggctgaggcgggtggatcacttgaagtcaggaatttgggaccagcctggccaacacagtgaaaccccggctctactaaaagtacaaaatttagctaggcgtggtggcaggcacctgtaatcccagctacttgggaggctgaggcaggagaattgcttgaacccaggaggtggaggttgcagcgagctgagattgcactccagcctgggtgacagagcaagactctgtctcaaaaaaaaaaaaaaaagtgatattgattgattctgcctgcaaatgatcactcaaatccatcatcttcatttcttactgtccctgcctaatttaaggtctttatcttcattgacctgcttggactagttaatggtacccaggtttttccaagttctaatcacctccatcccttctttgatgggtcttggcttgtctccttgtcttcagtcttgcctccatctaacccagctggctgaacattaaaatcacctggagttctggtaccaaaacccagtgactgggccttacctctgagtctgatgcaactggtccggagctgctgggtgattctaatgtgcacctagaggtgaggaccatgtactaagccaccctccacatggtaaaacagggctgtgcttacttcagcagcacatgtactaaaattggaccaacacagagatgatgagcatggcccctgtccaaggatgacatgcaaatgtgtgaagtgttcccccaaaaaaaaccagaaaacagagctgatcacaacctccagatctacctatggggcatctttctctccagacttctctctccctgcttcccctgcaaacctgcatcctagccacgaattacatgctattccctgatggcacaaaaactgttctgtacctccctactttggcacgtggtgaaccctctgcctggaacgtcctccctgctccatctcgcccctttatcttcctgctcttccttccagacctaactccaggaagtgtccctctccaggaagctcctctgatccccactggaaaggtgtgcctcccctttgtgccctttgacgttgcccctgtctctcatgtttgacccatctcaagacttttgtacctaggttatctgcttctcctagacaacatgaccctaccaagggacaagggtaagagcacgggctgtgcaggcaatagcacacctggcagtcctgcctccagagttactggctttatgaccttgtgcagtttcacttccttcccctctctgagcctcaattttctcatctgtaaaatggggatgcaaatacctgccttttaggattgttttgtgcatcagaaaaaatgtaaagcttttgacttagcatcaaagctgactcacaggcactcagtgtcttgttaactcttagtattcacctgagcatcctcagtggttagcatagaacccagtggtcctcagttttttaaacaaatgagtggaacagacagatgggtgctgctggaattcagggaagggagtgagggggcagtgttgatttaaataaaagtagcttcatagaggggatgggatgtgagctggaccagaatctagaaaagcagagaggaaaatggaaaggccttcctgggtagggtggggcagtgaacagaatgagagcaaaggcacagagacaagtctgaacataagtgagactgaacgagctagaaggaatgtgaagtccagagtagacaatgatgacaaccattttattaaaaaaaaatagtgtctactatgtgttagctgctgtgctactaacaggcactggtttttgccagtgatctatattacaaggcatggccatcctctcctgggcttccagcctagtggggagggctagctggtcaacagacagtgtggtgagagcaggtgcagggtgatatcacagcacagagaagcaacccatccaggcatggggaccagagaggaacattactgatggaagtctaaactaggacctaaaagatcaatgggaaccagctggccaacatggtggaaccccatctctactaaaaatacaaaaattagccaggtgtggtggggcatgcctataatcccagcttcttgggaggctgaggcactgtactccagcctgggcgacagagcaagactctgtctc

SEQ ID NO: 350 - DNA, 2732 bp, Homo sapiens
gcaaccgcagcccagccccagtccgggaggaagttctgccgggcgctctccgccggtgcctcactggttatagtgctatacaggaaacctggcagcgccggagccgcgcggtcgaggagggagcgcgggacgccgagcccacgcgcgcctgccgggacaagtggagacgaggccggcgagcggacgccccgaggttggcgaaggagctgtggccgggtccccttcttatccagcccgagacactgcgctccggtgggcgtccctgcgctgggaatccctctcggagtttttccaggcccggccgggttgctccgggaaaggccctgttgggggaggtgggcccggagctggcaggtctacaatccggttggaagggctcgcagtgggtgattcagggtgccaatgacctccccgcgaacgggaacgcccgcactagacaaccagccccagaccggcattcccagagccgcaggcgggagggacgcagggactccgggacagcaaatccccgggggagaagggaagggggaaggcgggacaggggaggcccaccctccttgggctccgctagcgaccagccagcgccccttcagacgcagccttcctggctccggaccccggctttctgctccggtcctcgtcccaatgccccccaaggtccccagcagaggcattcaggttcctcctcgccccgcccagacgcagcttctttgggtatgggtgacagcactcctgagcgtcgctgtccctattcgctgccgttgccagctccgattccgcgaaacctctccggcaccacctcggaagccccgcccagggcgatggtccgggcctaacctgccggccccgcccacccggcccttgggctccctgaggcccgcccagcagacaccggagagcaatggtgtgatctccgcacactgcaacctctgcctccagggttcaagtggttctcctgcctcagcctcccaagcagatgggactacaggtactggtagttaactctcaaggagaaatttcacggttgagcaccgaaaagaaagtggtcatgaaaggaagtatcaacaattatcttaaattgggtcaagaagggaagtatcgcgtctaccacaatcaatactccactaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaaccgggcatcacatagggcaaactggatcaaggcagttcagatgtgtagcaaactcagagaatttgcattggctttagccattttggagtgtgcagttaaaccagttgtgatgctaccaatatggcgagaatctttaggacataccagctttctccctttgtctcataaccatgtccaccaatgagaatgctaatacacaagctgcccatcttcacagatctaagaacaagggaaaggacagtacagaaacgaggcgtcacagaatagaggtcaatgtggagctgaggaaagctaagaaggatgaccagatgctgaagaggagaaatgtaagctcatttcctgatgatgctacttctccgctgcaggaaaactgcaacaaccagactcctgccctaagagccatagggaatatcgtcactggtacagatgaacagactcaggttgtgattgatgcaggagcactcgccgtctttcccagcctgctcaccaaccccaaaactaacattcagaaggaagctacgtggacaatgtcaaacatcacagccagccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttacctgcaaaagataccaagattattctggttatcctggatgccatttcaaatatctttcaggctgctgagaaactaggtgaaactgagaaacttagtataatgattgaagaatgtggaggcgtagacaaaattgaagctctacaaaaccatgaaaatgagtctgtatataaggcttcattaagcttaactgagaagtatttctctgtagagctgccagagcagagctgagccacccattgctggagaggacatccacgcaggcctggacgagccggactgccttactaaggatttcctccgtatctgactgcaactcagcactcagctgcatgcgggacaggaagaggaagatcaaaacgttgtgccagaaactacctctgaaggctacactttccaagttcaggatggggctcctgggacctttaacttttagatcatgtagctgaggcataaatttgttgtgtactatgtttggtattttgtcttattgtttctctactaagaactctttcttaaatgtggtttgttattgtagcactttttacactgaaactatacttgaacagttccaactgtacatactgtatgaagcttgtcctctgactaggtttctaatttctatgtggaatttcctatcttgcagcatcctgtaaataaacattcaagtccacccttttcttgacttc

SEQ ID NO: 351 - DNA, 2901 bp, Homo sapiens
ttgaaatcaggaaatcaggccgggcgcagtggctcatgcctgtaagcccagcactttgggaggcggaggcgggtggatccattgaggtcaggagctcaagaccagcctggtcaacatggtgaaaccccgtctctactaaaaatacaaaaaaaaaattagctgggcgtgttggcgggagcctgtagtcccagctacacgggaggctaaggtgggagaattgcttgaacccgggaggcggaggttgcagtgagctgagattgcaccattgcactccagcctgggcgacagagcaagactctctcaaaaaaaaaaaaaaagaaagaaagaaatcagaaaatcgaccacagtggtagccacctggcctaatgctgtgtttttgtacctgacaggggtcactcattttaggcacaactccttcattctttgtgaaattagtgagtttccttctacccgtcaccagattcaatatgttctattaatacaccgataaccacaggggaagggcacttgtcgctctcccacctggttaccacagtctccatgggtcttttgccgtgaccacaaataaaggaaacactcatcactagtatctaagtcgggctttacagtaactatgcaccttctgtgtgcttcacctcactctctacttcaaacagcccatggagggaggtattattatactccttatgttgacagtgaagaatctgaggcccagagaggttggggacttgagtaaagtcacacagccctgagaggcaggaccagggttccattcctgctctatccagttccaagcccttgtgttttccattatgtttagtgcctctttgctaacagcaacatctgcaagatttgtgttggttttgatggagaactctagctcatccacatgctagtgcccaagtggtggaggggccacctcagcaggtgggttctgaatgcagccaaggctgtccccgcaatgggtgagactcgctccaactgcccgccctcagagcaggtgcctaagtcctccctggcactggcaggccttacctcacattgctaaattaaagcaatgcaattcctcttgggtaagaggaattcctccttctttactaactgatccccagcaaggaaataaaatgttaggctttaaaaatccctactttgtcatatcagactatattctaaaactatatttgagcgaaacctgtcattgcgtctaatttcaaatatacagaatctccttaagagctgttgccttatttttttgtaaagcctctctgacatcaaatggggagaaatggtggcacctccagacaccctgaaactacacaccatttcttccctgctcagcttctgctcaggagttctgtgagctatgggaaggccattggttgtatttgctacttttactttcatcttcctctgctgtagagccatttaatgttattgtcatatgctgctggtgaggtaaaggtgggtccgggtgccttcccaggggttagaggatgttcaaagggccgatttcagcaggagttcagagggcttatgatggatggtgagagatttgacaaccaccagagcacatgtgctctgaccctctcctgggcattggttcctgctggtaccgggcggttcagaccttcaaataggttgctttcaaaagagctttcaggcacttattgagaattaatgtttaaacagacataatagcctagatgaactcccaagagatctattaaatcttgtgggctgaataaatatctcgtgcaggactgtgcaacagtagcccagagcatcctgcctgtgggcatccacctcccaggtgagggcagtgggaagctggcccgacggcagccagaacttgtttctcacctcccaccagcaaccccccacccaactctgggccccaggcacacgaagcacaagtctcaggggaccattcccacattgggggatcctgagggagcccatcaccgcctcttgcatacaactgtccactaggaggcacgcccagtgtgggagagatgtatggtcttgccttccacctgtaaaaactgcacatatgcaagccatttgcactctggaactgcatgccgtgaaaactcctaatggtgtggaacttagtttgaatttgaaatcacgccgcatgcacaaagggacaggcccaggcccgacctcaggtcatccgcccgctggctgcagagcatccctgggagccaaggcgaggcccgtggagcctgagctttgtgtagctcgagctttgtgtagctcgtgcacttattatgcaccacctcccttcagtcaccactcctcttcctccgccatcctcatttatactgattgcacaccccccgctcaaacaacaatgtccttattatgatgaccatctcgtagtggtacattccattcctatttaaggtaagcccaaagcccacttttggattttctcgactgtccgagaaaagttgtgtaagcgcctgcgttcttctgggtttggctagatagggttgtgtccctctatggaatggagagtgatgtgggcaagggtgtcattttctcgcacaatacaactcactgaggatgcttctgtagaagtgagaaacacgatgagtacattcagaattacaataactcactctcactgggtaacttctcatgatagatttgtatgatcaatacgggtctatttttatgtcaactgaacactgtagggtaccttccagtctttttcaagattgttaaattgagacaagtaattgaataatttgtcctatttttattttaaaaaaagtgaatggactgaaatgttaaatgtgaatgtacatttcttaattgcaatttttctactgagtgtttgcactatactttctggaatcttatttaacaaaaataaagggaaaaaattgcttgact

SEQ ID NO: 352 - DNA, 2293 bp, Homo sapiens
cagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttc

SEQ ID NO: 353 - DNA, 2002 bp, Homo sapiens
aagaattccgtggctttggaaaataaaactgctgttatagctcttctgggtatttgagaaatgcacttgtgaagggttagagttgaatcttttgatgcgaaagtcgggttttcctgatactgggattccgggattccaggtgttggggtggcccaattcctgcgagaagcaatagcgggcggtaacatgaggagcacggtgcgtccagcgagtccttccgcctggggccctgccgaccccctgcctgcgcccccaggactctggcctcacccggccgtgccggggcctctgtgacgcggcgttccaggcactcggccccggccgagcccgtagctagagcggctcagagacaggaggcggcggcagcagcggcggcatgaaccactgccagctaccggtggtgatcgacaacggctcgggaatgatcaaggcgggcgtggctgggtgccgggagccccagtttatctacccgaacattatcggccgcgccaagggccagagccgcgcggcccagggcgggctagaactctgcgtgggcgaccaagctcaggactggaggagctcgctgttcatcagttacccagtggagcgtggtctcattacttcatgggaggacatggagatcatgtggaagcatatctatgactataacctaaagctgaagccgtgtgatggcccagtcttgattactgagccagcgctgaacccactggccaaccggcaacagatcacggaaatgttttttgagcatctgggtgttcctgccttctatatgtccatccaggctgtgctggctctctttgctgctggcttcactactggccttgtgctgaattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaacgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgttttt

SEQ ID NO: 354 - DNA, 2047 bp, Homo sapiens
atcgaagggtagatcctgggcatcggagttttttaagttacccagatgactctaatgtgaaaatagggttggaaagttctagtatcacctctcccttgcccctccccacccagattctttcatctctacttcccaagctttctctggagtcctcttcccgttcctccagccccttctcctctctgcaccttccccatcagctcagccaaccatagcagatccctggagagggggcaggtcccatgagtggtactctgaggctggttcctgcatccagcctgcgggctgctcccaaacaatttccagcttttctaggagcagaaacctactctctgcaggattctctgttcacctgcaccttctccaggttcccaaactccaaaagtttaaagggcactttggcgacatttctgtctccaagccccagtcttgatggtatggcccatgtaagtcttataacccaagccttggccatttctgcagagccacctgagttgaatgaggatctactgttaacagagaaaggggtcacagtgctcccccagcaagtcctttttccaacaaccaacctcctcagccatctaggatttggatccacaatgcagcagctactgtgcattcaaatcctagatggctgagaagaggcatctcacccttcacatctacaagatctccactgctgggtatgagtaaatgtgtgtgtgagtgcgtgtacacgtacatgtgcacacactgtctacatacaaaccatctagatctatagagatgccaggcttcactttacatgtgattacattctacatgaaaacagttgagggctttcgttatctttcacttgatggagtttcactgtattatgttcatgatgggccccagtgaactccatatcaggtatatacatagaatgtataatatatacaaactgttagacacactacacacacacacacacacacacacacacacacaaagcctagggaaacctgtgatgtgggtaagttcattttgccatcccatctcctccatctaagtaatttcccggggcaagcattgtttcacacactcccctcagctgcccagccattccctctccagtgtcccataccaccaagccttctttccccatcagtccaaatgtccctgccctatgtcccatctctcagggtcctactctctgataggtgacagttcagtcagtgggtgctaaagagtcgagtgttacccttcccaggtgacatttacattttaataggggctacagataatgccttaatcagaaagagtggctgtagtggtgggaatttcaggcacagaagtgggccagtaagggagattcttttatatcaggagggcattttagagcccccgagtcatacctgtctgtaagcgcagcccttcataagtgcatgagcacaagcaagcacacttacctacattataccctccataattttgagatacctcccttgcattggccctatctttaaaaatgaaaaaaaaaaaacccaaaaaaaacaaaaacaaaacagggaactagctaaattaatttagatctcgctgggaaacgtagcctattttttcaccggctgccagccatctggcccaccccaccctgttcaatttcccttctgctctctatcttttcagctatgactgactatatcagttaatttacttgtacgtgtcctctctgctgtctccttaccctgctcccctacaccatgtatttccttcctttaccatttcctccttggaattgtgctgtgtttcgttgtcctggaggacagaagagcaggttaaggcatgagcatgtgtgtatcactttgaagaaagagaaaccaggtattctgctacagtttggagaaaaacccaatgaaggaagaaatgaaagctggctctgcagagtgccttaaaaatgactttaattaggaaattctgagttgtcagtcttcagatgttacataaactcaaacagatgttgcatttcacttctctgggattaaaaaaagttaaatacagtgtgtattcaacaacaaaaaaaaaaaag

SEQ ID NO: 355 - DNA, 2053 bp, Homo sapiens
caaggtttccccagccatgctgaactgtgagtcaattaaacctctttcctttataaattacccagtcttgggtatgtctttattggaagcatgagaacagactaatacagtaaattggtactgccagtggggtgctgctataaatatactcagaaatgtgcaagcaactttgtaactgggtgacaggcagaggttggaacagtttgaagggcttagaagatgatatgaaaatgttggaaagtctggaacttcctggagactgagggctcagaagacaggaagatgtggaaaagtttagaacttcctagagacttgttgaatggcttcgatcaaaatgctgatagtgatatggacaataaagtccaagctgaggtggtctcagatagagatgagaaactcattggaaactggagcaaaggtcactcttgctatgcaaagggactggcagcattttgcccctgccctagagatctatagaactttgaacttgagagagatgatttagtgtatctgatagaagaaatttcttttcttttttttctttttttgagacagagtcttgcactgttgcccaggctggagtgcagtggcatgatctcggctaactgcaagctccgcttcccgggttcacgccattctcctgcctcagcctcccgagtagctgggactacaggcgcccgccatcgcgcccggctaattttttgtatttttagtagagacggggtttcaccttgttagccaggatggtctcgatctcctgacctcgtgatccacctgcctcaacctcccaaagtgctgggattacaggcgtgagccactgcagccagcctctgacagaagaaatttctaagcaacaaagcattcaagaggaagcagagcagaaaactttggaaaatttgcagcctgattatgcaatagaaaagaaaccccattttctggggagaaattcaagcctgctgcagaaatttgcaaaagtagtaagaagctgaatgttaatctccaagacaatgtggaaaatgtctccagggcatgtcagagaccttcacaacagcccctcccatcacaggtcaggaggccttggagggaaaatggtttccttcaccaggtccaaggcccccctgctgtgtgcagcctagggacttggtgccctatgttccagccactccagccatggctaaagggagccaaggtacagctcaggccatggcttcagaaggtgcaagccccaagccttggcaacttccacatggtgttgagcatgcaggtgcacagaagaattgaggtttgggaaactctgcctagatttcaaaggctgtatggaaatgcctggatgtccaggcataaatgtgctgcagggcagagccctcatggagaagttttgctagggcagagcagaaaggaaatgtggggttggagttcccacatagagtccccactagggcaatgcctagtagagctgtaagaagagggccaccatcctccagactccagaatggtagatccaccaacagcttgcactgtgtgcctggaaaagtcacagatactcaacatcagcccacgaaagcagccaggagtggggctgtaccctgtaaagccatggggcaaagctgcccaagaccttggaaacccacctcttgtatcagtgttgctgggaataggtcccaagactggccataaacaagatctctgcagcactgtgacatgcttatgatggctatgacgctcacactggaagttgctggtttaccagaatgagggcaaggaacatctggcccacccagggtggaaaaccgctcaagatgttcccaaaccacaaacaatggcatgagcgatctgtgccttaaggacatgttcctgctgcagatagcaagccagagcctgtccctttgttccccataaaggatacttttagttaatctataaactgcagaaacgatgtttatcatgggcttactgtcaataaacaggtgggtcaaactctgttcgaggcactcagctctgaaggctgttagccctctgatcccactttgcactctaaaaaaaaaaaaaaaac

SEQ ID NO: 356 - DNA, 2247 bp, Homo sapiens
gtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggagtcatctgaggccactgctatttcccaagagaagagccaggaggaagaaagaatggctgttgggcttcttaaagccatgtaccaggagttggtgaccttcagagatgtggctgtagacttctcccaagaggaatgggattgtctggattcttctcaaagacatctgtacagtaatgtgatgctagagaactacaggatcttggtatcactgggactttgcttttccaaaccaagtgtgatattattgttggaacaaggaaaagcaccctggatggtgaagagagagctgacaaaaggcttgtgctcaggctgggagcctatatgtgagactgaagaattaaccccaaagcaggatttttatgaagaacatcaatcccagaagataatagaaacacttacaagctataaccttgaatactccagtttgagagaagagtggaaatgtgagggctattttgaaaggcaaccaggtaatcagaaggcgtgtttcaaggaagagataatcactcatgaagaacccctttttgatgagagagaacaagaatataaatcttggggaagttttcatcagaacccactgctttgtacacaaaagataatccccaaagaggagaaagtacataaacatgacacacaaaagagaagctttaaaaaaaatttaatggctattaagcccaagagtgtctgtgcagagaagaaacttttgaaatgtaatgactgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaaccttacgaatgtaaggtatgtcgaaaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatgaatgtaatgtctgtgggaaagcatttagccttcgtgcataccttactgtacatcagagaatacatactggagagagaccctatgaatgtaaggaatgtgggaaggcctttagccagaattcacaccttgctcaacatcagagaattcatactggagaaaaaccttataagtgtcaggaatgtaggaaagcattcagccagattgcctaccttgctcagcatcaaagagttcatactggagagaaaccctatgaatgtattgaatgtgggaaggcttttagcaatgactcgtcccttactcaacatcagcgagttcatactggagagaaaccttatgaatgtactgtttgtggaaaggcttttagttactgtggatcccttgcccaacatcagagaattcatactggagagagaccctatgaatgtaaggaatgcaaaaaaaccttcaggcagcatgcacaccttgctcatcaccagagaattcacattggggagtcactgtcaccacccaacccagtcaatcaccaagtcctatagatcctgagtcctaaatgtttctagaatttatactgttttttatctttaatgttgtcaccttggtctgattcatctcactctgattactaatatagctttcaaacagg

SEQ ID NO: 357 - DNA, 3645 bp, Homo sapiens
ataggaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcacgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcagggtggatctatgacatcacgcaaaaatatgatttttccttctacatatgtggtttgctttacatgataggaatactctttttacttattcagccgtgcattcgaattatagaacaatccagaagaaaatacatggatggtgcacatgtttagtatcatgtaatgttccgtgtaggtttcattgtaatactcatgcctacctcgcatggttgctgtgaggcacctatgacaggacgtgggaaagcattttgtacggtaactggcactgtcatttgtaaatgccattgtcacagcctcatttgtaagcagcactgcctctctgtttggggagatgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgactagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaatggaatgccattagtgtagatgtctgtgccacatctgacactggagtagcgataacaaatagcccatctctagactctcgtgttgttatatagaccattcatttgcctgagcgtggcacagttttaaaaatagttctcttgattgatttcatacagaagatgactgtgatccatgacatctaataatgccctttctttatctgagatgtctatttttctaagccaaacgcttttcagactgcagaatgttcttcccagatcatttgaaatttctggctgccttacttgtttacagatagtttaagactatttaaatttctactcacaatttgatcatcacacacacacaaatccttgaatatcattgccagtgtcttaggtcaaatttacctaaagtgaatacagcccattctcaattatccttcacaattagacgcaggaatgctactaggaattggaatcaaacaatgccaccccaagcgtaattttagccagcagtttcagttatactcaaccatgcccttctgagctgttaacaagtgattcaatggacaagttctctttttgttccatctccattatttcctgctctaatgtatagtgggagtggttgtgtaatgaaaggaccaccaaaataataaaaggcagctaatggaaaggagagacaaaagcatggttaatatatatacttaatattacctccaatgactcaggaattgcctgtaaattattatagacaatagattgcatgtcatactccatttggttcaacacaacaacctatgtgttatcattacagctttggctgctgttaaagaatccagctctctattttgataaagataatcttaaagctgaggcaatgctccctcctctatctctctctgtgtaatttaccatagaattaggatgattagattgaaacgcatgttgtatgttttaaaaactacattgcttcattactttcattttccgacaacatcaaactaacaagaggcagtgttaaatattttaaatggtgctatagccaatgtatttgaatgcttgcactgctggttgtgtatcatcaatatgaactttttatccaatgactcaactctaattacatctaagttagacttgctcacgttcagtttgtacagttgtgtgttgacttactatgttttgaaagtggtgacttctaccgaatgagtggaagttcccattgtcaaaaaaaataaagacctgcttgcagtattcatgttgacaacagagtaaaagagaatactgtaaagaattactgcaaatatttcctgtttatgttatttgccgttgtttgaagatattataaagggttaattgtatatttatatcatgtgctttattgttttcccctcatgtatccaagtaatttttatttacatacaactaaataaatgttgtcctctttg

SEQ ID NO: 358 - DNA, 2888 bp, Homo sapiens
ccgttactctgctggcactgccaccgcaaggtcccacagacttggcggcttaaacaaccgaaattgatttcatcacaattctggaggctctaagtccaacagcaaagtgtgacacgattggtttcttctgagggcctctctcgtctgcttgtcgatggccgtctcctggtgttttcacatggtcttccctctgtgcgtgtctgtgtcctgcttttgtcttagaaggacaatagtcatgtaggattagggtccacccatatgacctcactttaccataattacctctttaaaggccctgtgtccaaatagagtcccattctgaggtactggggtttaggtctctaacatgaacttgagggggatgcagtttagcccataacactaactctgacccctctcacgagcatcaggcctgcagatccagctccccctcccactccccatgtctctctctacagcgtgtcccaaagagatccctcctggcccccttaccattccttcctcctgctttcccgatccagatcagggccttgggatcatctctgactctcccccatcctccttcccatcacttggtcgtctgttgaattgtctgcacatcttctgtgtttgcctgttccttcatattgccagtgccatggtttgagccactaacattcccagacacttctgcctggtcatcttcctctccagcagcccagcttacattcacttgccttactaagcagagctccagctctgtccttcccttgcctgggaagcttccattgctccccactgctgtagggtatcataacggtcttgtgaggtagacaggctaggtattgttattgttatttggtagttttagagatgaggaactaaggacccagttgctcagtgtttcctagctagtgaatagagactagacaccaagtgttctacgtgcagactttatactgctcagcctggcacacaaaatggcaatggcatagtccccagactgtggtcccaactgtctctttcctaacagctccccaggcacccacacttttctgcctctttttcaatctgtacccttgaccctcctcctttttctgctttgtcagactccttaaggcacttcataaattaaccatttccagggatttcccctcacacatgagttattccagtggacagggcagcctcatgggtgcctgtggagggtgaagggtctgcctggccgtaggtgtgatcacacactcccgttgtaacccctgtctcctgtgacacttgctgccccacgatttagctgctttgtgttccgtgcctcctgtttgctggtgaactcctgagttggggggcgtcattccctccactgtagttcttccgtgatgctgactccacccacggtcagcaccactcggaaatacttcacagtcctgtagaggaagacaggtccaggtttccagttacccttctatgtctggatactctgctcattcactgaagccaggccccttcctgcacttatgcctctacccagataatgagttctacccactgatgacctcctctcctctagtaacagtccgcctccctaatgagcatctctggctgacacacgttccgttctccaggcctgtgagccctggtccctcgctgttgctgagccacagcacccgcccttctggcctcactttagagcactgtcatttcagagcagactacgcgtggggtggccaggtgaaatgcagctgacggctctgcgaccaaatgtgaccaaagggccacattcccagcacccggctccaaaggcagagcttggattctatgcccagcacaggttttcagggcttccttctctctctgggcctaaacagtgatccctttccctgtttcccactacatctggcagaatttaggccacatttcattttcttcttccgcccatggggctccctgcccactgtgttcccctgtcactctgtccaggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcatgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaacttggcgaaaccccatctctactgaaaatacaaaaattagccaggcctggtggcaggttcctgtaatcccagctacttggggggctgaggcaggagaatcgcttgaacccgggaggtaaaggttgcagtgagctgagatcgcaccaccgcactctcctgcctgggtgacagagcgagactccatctc

SEQ ID NO: 359 - DNA, 3202 bp, Homo sapiens
tccaaaatcctgcagctatcctgccctatacacaaagagcccagatccaggccccacacacttgatattggggccagactcttccacctgtgaaacctcacaggttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctaccttgtcttcccaccagccgcctccctccatcaagttcctttccacgtctgcttgtgcccctgttgtccctcagtttgtccaccctcctccaatcttcccctccccaaacccatgactgatcagtggcccccaacctaggctcccacctccatgcaggtcttggcccctcggctgacctccctccaacctccccctctgctcttaattttgaataggtagtgactgtaaaagtatccctgggcttctatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcacatgctcggtgcttccaatcggtgattaagaccactgctcttcatccagagcaggcagcagggattcccaggtatccaaagaaaccaaaacaggcggtgtaatttaggactgactaagtaatggctcggccacttttaagtgtggaagcaaaactgaccccacagatttagaaaactgtaacactgcttattgggagaaactagtgtcaccctggctagttctgctccccaaattcaaaggtaaataaacggttgagcatgtccgatcagcctggagggaaacctccacccccgactttgtaggactgacatctgaagacgtcagagactgcggtcacaaccgtcggtacctccttagggcgcttaacagaggtcaaagatggccctcgcaccctcctggcgggagaaagcccaggctcagggtggtcttctacaccaccgcctctcccgggtccacttggaagcgagtcccagcgaactactcgacctaggaaaccactgggccgccacttccagcctcttcggaagtcgaggcaacgctcctgaacgttgccacgggaacagctggaggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatacctctgggactctgccgtacctcctagaggaacagagcgcctctcaggcgtcagaggctgctgcaaatgcgggtcagcgggccacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgtggggacgcccagcttgagcgcaggcgtgtcccccaagcgccgagccctgccgtccgtcgctggccttttcacacagccttcggggtctcccctcaacctcaactccatggtaaggatggggaccggcagggctggggagcgcggcctgtgaaagaaagaccagagggagaccgggcgcggtggctcacgcctgtaatcccagcattttgggaggccgaggcgggtggatcacaagatcaggacatcaagaccatcctggctaacacggtgaaaccccgtctctaccaaaaatacaaaagatcagccgggcgtggtggcgggtgcctgggaggctgaggcaggagaatgatgtgaacccgggaggcggggcttgcagtgaactgagatcggccactgcctgggccacagagcgagactccctctcggggggac

SEQ ID NO: 360 - DNA, 2959 bp, Homo sapiens
ctgagatgagacttcatggaaggggctacaaggtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcagaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttct

SEQ ID NO: 361 - DNA, 2941 bp, Homo sapiens
acagtgcggtaaagccaagggagattatccagacccccaggagcgaacagcaagcagcaaccgaaggcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacacccagcaagacaaaggccgtcgtctccgccatgacactgttccgttccaagcagaggccgggattctggactcctcgaaaaatcaaaaagaaacaaggaaaacaaacaacaaatacagcaacaaacagaaaaaactgaaaaccaccaaaatcgtttgcccgtttgcccgtgccaggggtgatctgggcatctgttgcagcagaaggcgcttgtgtggggctaatttttcttttggtggggggggcaagctgttggcttgtttgctatttcaacttcgtttataattaacttaaaaaaaaccccaccattcagcctagtcaacaacaaacaaagaaaaagcagacatcggaagagaaatgccataggaagcggcatgaatacatgccacagccggtgccacttgccactcggaaaacctcagggaaagatgccaattctacagctgcgaagaaggcagagaaaggaggataaaggtctacaactagaaatcataaggaaagaatactgcttgtataatcctggattgcaattgcacacagcctctgctgggagaagagagggaatatttaaatggagatatagatgggtataaattaaaagataggcacctatcgattgcgtataaacacatgtgtaaggttgtatgtgtatataaatatgcatattttcagacaaacgtttagatatgtatatattttgtgctacaggtatgggtatgtatataggtgtatatgtttatgcatatacacacatatgtaggatgtatgcatgtgtgagaaaaaggagggagagagaggagagagaaggaaatatgtgtatgtgcatgtatgtgtatgcatacatcccactttttgacccaggtatacacagaagacaaaataaaaatcatactccagcagcaagcaggcagccagagatttatctacattcactgctatcaccagggagatgaatggggccgatctgaagcccttttacaagatccactatgggagtgaaggaggaggagggatgccacacagacatgcacaaacttgaaggcagagcgatttggaaggggctactgaggaaacactggtggcataacgcaggggagaagaaggggaaagaggcttgtctctctctctctatgttttaggtggttgtttttaaaaaatctgcaaaagggtttcagggaacggctggtacttacgttgtctgcgttgctgtggatcctgaaaggtgttctgttggcaccgggcgctgagccaggggcaggcgctggaaacaaaagggagagacaaaaaaataaagtgattcaatgggaatattaattgctgctcttgtggattttacaaaacacataaactgttttctttttctttcttaaaaaaaaatgtggattggcgcgtgtcccttttgcatggaatatacaagtagtatgggatttacagcccagttacgggactcaggattatctgcgctggcatcttttgggcatattcttccttttaatgaatgagctttcgctgttaatgaggaataatcgtttggctaatgagctttgaaacattaagagaaaagaggttttttccgttaatcgctctggtgcgactgcatggatggattacaaaagacagcaataggaacgcagtacaaagggggggacctctcctgcagtgggagaagcaccgagatgggtgatgtgtccctgcgtctttccttccttctctctttcgctctctctgccaactgctatgggtttccataactctgcaatcaaagtggatggtcgggaaggattattacacagagtgaagcctccgctgttaatgtctccagtgtttaatcatcatacagtagaatggttttatgcatatttcatttgcatatcattaaactgtgttagtgaggggcattcagaaccaggagaagtacaaagttggggagagagggaagaaaaaaaggtccctatgatgcttatcttcaaacggggacttgttccatgatctgtcttctacttttgctaaaatcattatgacttggaaacctttgaagttggatacaaccttggattcttctaattcctgcagagcagtgtattttacaaaacagcagaaatgttcctgcactagacaattaaaggaatataaactccggtgggctgaaactagtagctctttggggaatgcagtagcagaggcttctacaaataccaacacttaaaaatatataataaacagcatcatattagaaacaaagaaaacgaagacaagaaatattaacacgtggattatatttgtttcttttggggggtaatgaactaaagagaatgaagaagccatcggtaatttatcccttcattaatgaacagtcacctttttgtatgtgtttgtttttgtcctttctttttgaagagggatgttgttacttttgaagcaattagtcaattattttgtagctctgatcttttccccctgcacccgacaggacagaaaggtggtggttagggaatatgtgagtacttggggagggggggacttggtggggagagaaagaatacagtgagttctttgtagatcttatacatgcacaacatattaattgggggcttttaaagctccctcaatgggctatttcattcctggtaaaacagcagctggttagccactactggtgactcttcaaatattacttcatttttattctgtc

SEQ ID NO: 362 - DNA, 3047 bp, Homo sapiens
gagtgtgtgtgagtgtgagcgtgtgtctgtgtgtgcgtgcgcggccgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgcaggcagaaagtcttcctacgaccgtcttttcccttagaggcaccagaatccctgtaaccattcatccaggtgttgagaagatatgtagcagccgagcacccatcttttgacaccgtcctctgaaatcagctttggagatgctttcactctgtccgtcttctgcagcagccaggcagagtgccgactccttcacagccgtgaggaactcttcaggctccagaagctcttaaacctgatctacaatggaaaaaattcttttttatctgtttctcattggcatagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacctagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgcaacaagatctctggtgtatgataacggaacacttgacattcttatcacaactgtaaaggatacaggtgcttttacctgcattgcttccaatcctgctggggaagcaacacaaatagtggatcttcatataattaagctccctcacttactaaatagtacaaaccatatccatgagcctgatcctggttcttcagatatctcaacttctaccaagtcaggttctaatacaagcagtagtaatggtgatactaaattgagtcaagataaaattgtggtggcggaagctacatcatcaacggcactactcaaatttaattttcaaagaaatatccctggaatacgtatgtttcaaatccagtacaatggtacttatgatgacacccttgtttacagaatgatacctcctacgagcaaaacttttctggtcaataatctggctgctggaactatgtatgacttgtgtgtcttggccatatatgatgatggcatcacttccctcactgccacaagagtcgtgggttgcatccagtttactacggaacaggattatgtgcgttgccatttcatgcagtcccagtttttgggaggcaccatgattattattattggtggaatcattgtagcatctgtgctggtattcatcattattctgatgatccggtataaggtttgcaacaataatgggcaacacaaggtcaccaaggttagcaatgtttattcccaaactaacggggctcaaatacaaggctgtagtgtaacgctgccccagtccgtgtccaaacaagctgtgggacacgaagagaatgcccagtgttgtaaagctaccagtgacaatgtgattcaatcttcagaaacttgttcgagtcaggactcctctaccactacctctgctttgcctccttcctggacttcaagcacttctgtgtcccaaaagcagaaaagaaagactggcacaaagccaagtacagaaccacagaatgaagccgtcacaaatgttgaatcccaaaacactaacaggaacaactcaactgccttgcagttagttagccgtcctcccgattctgtcacagaggggcccacgtctaaaagagcacatataaagccaaatgctttgctgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtatttttttttaaaaaagaaaaaaagcctacattggcatcaagttctgtatcaatccatcttacattgccatccatgatttaacagactgtagaatcttgaataatctatatcactttaacaaataaatgttttactatgac

SEQ ID NO: 363 - DNA, 2662 bp, Homo sapiens
agcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcagcctcccaaagtgctgggactacaggcatgagccaccgtgcccggcctcttagttgttttttaaaaattatgtacattttaagtattttgcaatgaagaaattcatgcaaacaagaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctataatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgatgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagatagctagtaaggtaaacttttcaaaggcaagagaggaagatatacaagaaattgaaagaataattaagtcagtaagaggtaatattcagttttggcaaactcctctgacttgagttgaaaatacttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgc

SEQ ID NO: 364 - DNA, 2775 bp, Homo sapiens
gattttatgcaacttcaaatttgaaattctagtgatgtaaattaacatttaggaaattgaattaaccattttcccttcaaaatggtagtggtaccttttggagtacttaagtattcttcagtgtattgtaagtaattttaaggattcttataaagaaccaacctggtaaaatgcatagataaaggtttctgtctggtataattttccttctacctgaaaggactttctttaacatttttgtagtgcaggtcttctgttgatgaatttgttcaacttttgtatgttaggaaaagtcttattttacctttagttttaaaagagatttttgttgtgtatagaattctagatagatagtttttgtatttgagtattttagagatgtggttcttctcacgtttattgtttttgatgagaaattcagtgtcattggtatttttcttcctttatatttaatgtgtttttttcctcttactatttttaagatttactctttatcattgaatttaagtggttgattatgttgtgtcctctttattttctttattttttatgcttggggttcagtgacctttttgtatctgtatacttatggttttcattaaattttgaaaattttaggccattatttcttcagctgttttttctgtctttcctcttcttcagggactcgagtacacatatgttttgttgcttaaagttgtttcagagttcacttgtgcttttttttttcacttgtgctttttttttaagtcccttttctctctgtttcattttaaatagttaaattttatttgtctccaagttcactaatcttttctttgcaatatttaatctgccattagtcccatccagtatatatatattttttatctcagacattgttgttttcattcctagaagtttgatttgagtctttttcatgtctttcatgtttctatgtgtttactgtgttcaattttcttctagcttcttgaacatatggaatacacatgtttaaatgtccgttcattaacttgatcatctggctcatttctgtatcagttttgattgattggcttttctactcattatgggttatatttttctgcctctctgcatgcctagtaatttttgattggatgtcatatattgtgaattataccttgctgggtgttgggatattttttatattcctaaaaatattcttgagctttgttctgggatgtggtttaattacttggcaacagtttgatttttttgagccttgttttcaagctttgtttagtggtaccagagcagcatttagactggggttactctctccccactactgaggaaagacccttctttcaattagagaatactgtaattgttctcccatgaattatgagtttttccactctggctggtaggaataaccactattcctggccctttttgagttccaggcactgttccctgtagtcctttttgggtgattctttctccagcctgggttaatttcctcacacgcatatgctgatcactaatcagctcaagacttgagggggactccttgcagatctctcgagttctttttctacatgattcttctctggtactctctcctgaaactattctccttagctttcctagactctcagtttctctccatatctcagggagaccactggattctgcctgagtttgcctctttgccctgtggccttaaaagtctctctagacagtaataagctggagcagttatagaggtgacctctgttgtttcttttctttcagggatcactgaccttttatcctgatgtccagtggcttgagagctgttcttcattcagttttttagttttcaggtggtagagttcatttggttcttgttactttatcttggcacgattttagttgcatctaattgtgtgttttagagtcgctatcaggagaaatgtttatttagaggagccaagatattctttctcaagtgatttgaattatctggtattctaggtacccaggtttaaaagcctgtatggtttttctgcacgtatttggcattctgttcttagttttctattccatggtactcaaagtagctggttcagaaactttgttactggtctgtgttggaatgaaaaatgtacactgcaatgtatgtaaatgcattactttcttcactgagaaagtattgctatgaaaagctgttaggtgaacccaacagtgtggttagtgatgtagttgatttatattttgtacaagtgtcttgtcttgatatagcctggtaactgtcggtggtctagtactgttcgcctagtcacactcttgagtagctgcttgtactttatattacgtagtttaacaaacgtggacttttatttaatatgctttttattgtactcaagaatatagataggttctgtaagattgtatccaggattattcagttgcagatataaaagaaagcaagcatccaaaagccaacctatattaacttcagttaccttgatttttaaaaaacttatacaattggccaggtgcggtggctcacgcctgtaatcccagcactttgggaggctgaggtgggtggatcacaaggtcaagagatcgagaccatcctggccaacatggtgaaacctcgtctctactaaaaatacaaaaattagctgagtgtggtggcacgcacctgtagtcctgctactcgggaggctgaggtaggagaattgcttgaacctgcgaggtggaggttgcagtgagccaagatcatgccactgcacttcagcctggcaacagagtgagactgcgttt

SEQ ID NO: 365 - DNA, 2838 bp, Homo sapiens
gtttttctaatagaatgaaagttgatatgattaaaggaaatatgacttcttcaattttagctattgctgatatctttcctaaattaaaacagaagctccacatgcaggctgaaagtaatcaactcacttgggaaaagaccatccttgctcttctgttcttttgccctactcacagagttgttcaaattcggtatttcaaattgtagatttcaagttgttaaccaaaaattttgtgttaagtgtagatttttttctccctggacttgaggctatatggggctggtaaacaacgatgtgttgtgaagtttagttcatgttgactgctcctttagaagagaggagcaattttaaacgtaattcttttcctctgctgcttcatatgagggtccaggttcatgtttaagtggggcttagtagccccgtggccttgtcatgttttttgctccctttggctctatagttactcattttcaatgtgtcttttctttagccagatgagtctaatgtagcagcatggttcccacgccttactttgtctcgtcttggtgcagtgtgccttgctgtctctcctcttgctcatattacatctcccaaatactgatgggtcatccctggctcctggttaacttggtaaaagttatatattgataaaagtcaaatattttttctgaattttcctgcctcttgatacactggactgtatatctagaaaggggaatggttataggattttatactgtaaatattttttttaattcaaaaaataaagaaactttattgctatccagaataggacttcaggatattacgtatttcttagtagacaggatttttcatagcattaagatactgcatgagccgtttgaagtctgcctttctttgtcttatttacatcccccattggcctctgttgccccctgaaatgcctcttcttcctgtaagcagatgttttatgactttttaaaataccctgctttcgtttcttacattaaggagggtttcccttggtctccatggtgttctctggattgagtcatagccacttcctcttgcttcaaaaaattccatctttattttagatacttcctttttatttgctgtacattaaaccttcctctcactccaagtgactttaggtaattattgcttttctctgtattcctttttgtccttcctggttcttttgctctttaaacaccatctttctatccttcatgggaaaatcttctgtttatagtttatggtgtggtaggtccttcagtttcattaattacccatctacttttgttttacataatcttcctctttcatgggagttgtaggcttctaggtttgggaagagctaaaaatgatctattttaattcttctcattttacaaatgagtaactggcccagagaggagcattaacctgttcaagacaactcagtaagttaacccaaaatagtttcaatatgcttaggtggctctattgcctgaaataccagttcaagtagataggctagagaggctgtccttttattctctattgttatttagtgtttaaacatagctgttgctgaacataatgccttcagtcactggaaatgctaatgcgttagttatgattttaacagaatgcttgcaaagcttaaatagaatgcatacaatccagaacatgccactcctgtgtaacttcggaagcatctccatgattcagaagggaggttctaagaatagaagcatcttagattgtcatagaagtctttggacactgccccccggaaaccaggccctgtctgcagtcttccttccctgggtagctcacatctgggagcacatatgttcagttgtattagaggtaaatttctggagacttttgtacctgcagagagaccactcttaaatagttttcaggtgtgaacaaggaagacttggtcatcaagtggaggtgtaagtgttgcttagagtctttgtgtgaaaaagatgagatagaggagaaatgtatcttagatttaaagtttgtctttgttggattatatttgagcagggaatgagctaattgtgagattactagaaattcataaagtaaggaggttagctagacaattttttttagagatgctgaattttcagaggtttgtaattcatgcaatttcttaaacaaatgcaagtgtacttaaatttattttctaggagacaaaacacctaggtggttgaccttctctatcctgtggaccaccatgaaccccacatacattgaccacatcagtgtgtaccaggaaacagtgggccgaggccttggagccagaacttctttgttcctctctgcccctctgttcttggcatgcaggtttagacactgaagatttcttccattagaaatgctatttgggtcctggagatgggtaggaaactcagggccctggtgccagaatccagcatatgtaacctctccaaaaacagtggtctggagatttgacatccattcttaaaaatgttaaagatgctccaaaaatagaccatttgagttttatttttcttcttcatgatcttttctcttaaacatataaaaataggctgggcatggtggtttacacctataatcccagcattttgggaagctgaggtgggcgaatcacttgaggctaggagtttgagaccagcttggccaacatggcgaaaccccatctctactaaaaatacaaaaagtaattgggcatggtggtacacacctgtaatcccagctacttgggaggctgaggcacgagaattgcttgaacctgggaggtggaggttgcaatgagccgggatcacaccactgcactccagcctgggcgacagagcgagacgttgtctc

SEQ ID NO: 366 - DNA, 2983 bp, Homo sapiens
tttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccggtgaaattctgggagaaaaactacaatacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttg

SEQ ID NO: 367 - DNA, 2038 bp, Homo sapiens
agcgattttcctgcctcagccttccgagtagctgggattacaggcgcgcaccaccacgcctggctaatttctgtatttttaatagagacgggtttcaccatgttggccaggctggtctcgaactcctgacctcaggtgatccgcccgcctcagcctcccaaagtgctggaattataggcgtgagcccaccgagcttggctgggtccttgtcttgaaatgtgtctctgagccattagccagaagggggcaaagaggcctggagggcagctttcccccactccccctccgttactctctgaatctgagctccaggtttgggcagttgaggtttagcctgaggccaaggacgaacgtgatggggtacaggagaagacttggcggtggagggggttttgtgtgcacatttacagagtcaggggcattcccagtccagaaaggattctcagaggcagtcacaaaaaggaatggggtggaagggctgagacttgagggagggaagggtggtgggggtagggccggggtgtggttgggtggatcgggttgatatttatatagggataggttgatcttggaaggctggagacggcaacgtggacaggaagaagcggagggcgaggaggagcagaggagcacacagatgaagcaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgc

SEQ ID NO: 368 - DNA, 2641 bp, Homo sapiens
tcttgctaattcaagcctgtgtgaacacttagaaaagctaacctgagtcctaggaagaaaaaaaatgtatgaagcagtggtgttgtgctgaaaataaaaacagtggggtaaaattagccatatatatatgggtatatatataaatatacatgctttaataacccgtgatataaatcaacaatcagccttatgagttataaagccattggataataattggaaaatggattacataatcacagccaaaaagcacgggaaatcatagaccttttgattttatcttcgaagatagatttaatttggatttaaacattttaattatatgcattaatcttatcttctccagtcctctagtttttgaaagtgattcttggccttagtaataacattcttgaagctgaatctatgctagtagatataacttccatggtaataaatagagttggaacaaagaggagaaagtggactgtcaaaacttgttcattgaatttgtaactttttccattaaacaataacttgtagtttatcaggtattcccaggaaaaatgaactgctctacctaaataaattttgtaggcaagaaccctaccccacctccaattttttatgttaactatttctgtgagaaaatcttacatttttcattctcctaaaacagggtaggcagaatataaccaaatacctctgttgattttatcctggacaactcagggtaacctcattactactcagtgtgctagtttctactcccacttctacctgtttatagcctgctgctcctggtgagtgacagttataacctaggcagaattccaggatttccaggggaagctaaataaagttcttaggacagtaagattaattttgtgtatattgctgcattaataggtcctatctgtgacaatgagggaaaaagggactggaatgggagcgggaagcctggagttctagatactactcttccaccaaacagctgtgtgataggagcaagcaacatgatttccccatccatatccctcctgtgctccaaggttctgaagatatcttcataggactgcagtaatgcaaagtacataaatttgtgacatcttttgctctcattattgggaagatttttttcttgcttttggatttggggctaagtaaaagatgtgttcgcttaaagtgaaatcgtagttaattggaattcaggaatcttatattctttcccaaattttataaaagactaattaggcatatactatgccaagcagtgtaacaggaacagtaaataaagtgatgaataggacagcccttatctttgccttcatggagtaaacagtcctgttgataagatgggcctcgaaattagcaatcctatatcaggagaaaagttaagaggcttctgcagggcacgaagtcaggggtgatgttagcgtggcaggggagtgtgttgaggcactgaggggagagaatattaaagagatatcttggaggtaaaactgataaacttggcaattgattccatgtgaggagtgaagaagagggaggaaacatggctaactcccaactttctggcttgagcaactgggggtgggaagggagataccatttcccaagaaagaaaatattggaggaattggaagagcagcagatattgcggggtgaaaggttgagagaaagaactgagtccagttcagaccgaggagcctgtgacacagtcaacaccaatgccaaggagccagtggatacaggggttgaggttgcagacataaacacaggattcatcagcatatgtgtggtttctgaacctatgggacaggatggcatcactcagggaaagagcacagagtcagaagaaaatatgacccaagaccaggccttgaagaactccgatatttaatgtttgggtagaagaaaaggcaaacgaaagtatctgaaaagatgggccagagaagagagaatcaaccaaggggagatggtcccagaagtcaaacagaagggagtgattcgctgtgatgaatgctgcagaggccaaataaggtgggaactttggctttagacatgtggacattatagtggtcttagactgagaagttttaagagatgatagggttggaatttcattgggaataatttgaagagtaacaggggagaaaatagagacaacaaaagcacatactctttaaagaagttttgctatacaggagatagaataatggatgggcaggcataggagatcaaggaagcatctttttaaaaactacagatgtcagcatgtttaaacgagaagagagagtgtgacagagagggagaggaaagaaagttggagtaagagtgagaaagagtaagattaatagatagcaaaatatagctgggcgaggtggctcatgcctgtaatctcagcactttgggaggccgggtggggggaaaatgtttcacgaggtcaggagttcgagaccaccctggccaacatggtgaaaccccgtctgtactaaaaatacaaaaattagccgagtgtggtggctcatgcctgtaatctcagctacttggctggctgagacaggagaagaatcccttgaacctagggaggcagaggttgtagtgagccaagatcgtgccactgcactctagcctgggtgacagagagagactccgtctc

SEQ ID NO: 369 - DNA, 2592 bp, Homo sapiens
tcaaaataagttacagacatcaatgcacttcatctttaaaccctttatcatgcatatcaggaagtagagtttaatatttctatatttcttgggggagaaatggagctaaaattatatactgtatcatatacaaacctgttaggtatatcaattcatgtgtattgacaaatgcgtgcaccatgtaacagaaactcctttcaagatatagaatattcctatcactacaaatattaatcaccaaaacaatggggagaatgtctctagggcatgtcagagaccttcactgcagcctctcccattataggccaggaggccttgaaggaaaaaaatggtttagtgggccaggcctcaggcacccccccttgctctttgcagccttgaaacatggtaccctgcgtccccagctgcttcagcttcagctgtggctaaaaggggccaacatacagctcaggccattgtttcagagagtgcaatccccaagctttggcagcttacacatggtgttgggcttgcaggagcacagaagtcaagaattgaggtttgggaacctctgcctagatttcagaggatgtatggaaatgcctggatgtccagacagaagtctgctgcaggggtagagctctcagggagaacctctgctagggcagtgcagaagggaaatgtggggttggagctcccccacagagtcttcactggggcactgtatagtggagctctgagaagagggccatagtcctccagaccccagaatggtagatccaccaatagcttgcaccatgcacctggaaaagccactggcactcaacaccagcccatgaaaagagctgtgagggtggctgcatcctgcaaagccacaggggaagagctgcccaaggctgtgggagcccaccccttgcatcattgtgacctggatagatgtgagacatggagcctaaggagatcattttggaactttaagctttaacgactgccctattggattttggacttgcatgggcctatagcccctttgttttggccaacttctcccatttggaatgggtatttttactcaattcctgtacccccattgtatcttggaaataactaacttgctttagattttacaggcttataggtggaagggacttgctttgtctcagatgagactttggacttggacttctgggttaatgtttgaatgagttaatactttgggggactattggaagggcatgattgtgttttgaaatgtgagaacatgagatttgggaggaactagggtcagaatgatgtggtttggttttgtgttcccacccaaatctctccttgaattgtaataatccccatgtgtcaggggtgggaccaggtggaggactgaatcatgggggtggtttccctcatgctattctcatgatagtgatttataacagatccaatggttttataagcatctggcatttcccctgctggcactcattctctctcctgccaccctgtgaagaggggccttccaccatgattgtaagtctcctggggcctccgaagccatgcggaactgtgagtcagttaagactctttcctttataaattacctagtcttgggtatttctttatggaagcatgagaatgaactaatgcacagggtaaaaatttaaaaacaaacatacaaatgcaagtaaacaagccaatatttcaactgttcccattgcattatccttattctttatctatggtaccagaaaataatacatctgaaacaatttttttttcctgccatgatgtacactcaagtgggtccactggggtttctttcagtttcccaaatactagatatgactcttccctataccttatcttcatatgaagaaagctatgagaatatattaataactgaatatagtaacactactataggaataagcatgtgtatattccaactgatcttttaaaacttttattttgaaatatttatagattcaaaggaagatgcaaagagtatagggaagtgctatatgccctttatctagttcctctagtggtatcaacttacataactgcagtatcatatataaaccaagaaattggcatctgtataatccacagacattactcagacttctctagttttacatacactaatttgtatgtgtgtgtgtgtgtgcgtgcacgtttatgtgtgtaggtctatgcaattttaccacatgtgtatatttgggtaaccactacaatgatcaagatatggaactgttccgtcaccactaagatcccttgtgctattcctttataaacatctccctgtcatcctttttcacccataaaagctagtaaacactaatctgttcttcatccttataattttattatttcagaattgttatataaatgtcatcatacagtatataacacatagagattggcttttgtcactcagcacaattcccttgagatgcatccaaactgttgtgtatatcagtaatgcaatatgtttaatttctgtgtagtattccatggtagagatgtgccatagtttaactattcacctgttgaacaacatttgtgttctttctacttttgggctattacaaataaagttgctatgaacattcatgt

SEQ ID NO: 370 - DNA, 3487 bp, Homo sapiens
cacacatttgacaattcacctcgtgttgctctgtgacaccgctgttattgcttaagtcttgggttgcttttagcttgttctttgtctgtttgagagcttgtgcccctccaggtgccttgcatagggcctggtatgccatacatgatggctgacgtgttaaagacatacacagtgcagtcctgtctttctccagaagccaacgctctaattgtggatgaagttgaggaacggccacactaacatggagtcaaggctgccctgacctgtttcgagaatgctccttctgacttccttttttccctaaggacattcaggaggcagaccctcttctccccaagtccctgctttctagaagcccctctgtctgggtttggctttctaggatgcaggccaccaggactctctctcccgctgtcatccctgcagggatcatggccccttaccccgttattcctgtgtccggcagagtcttcggatgactcctacgtgtccgctggagaagagcccctagaggcccctgtgtttgagatccccctgcagaatgtggtggtggcaccaggggcagatgtgctgctcaaatgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggtgagtacctgatttctccatgaatgcccacctggccctggccccttccttcccccactgtctgctctcacacagcctcagttagaggatgccaccactgaaagggccttaaggggcccctagtccagctgcttatattattgttgagtgaaccaaagcccagagacaggaagtgacctgcccaaagctgcacagcacattgttccgtgctcagcttactacacaacaccaccttccctgttgctccatcacggagccctggcggcagccagagaccctgcacctgccactggccaagctctctctacactcttctgagcctttgtcaccctgctctgcccaggaccctccctcatccccctccccttctcctctcgcccctttgcccaccctcccatcccattgctgtgcagaagctactgtgaggtagcggtggggagagtctggtggctggacccgttcggaggggcccttggggtggcttaggcttggagcatcacagggaccccagggtgccagggtgagcacagctgtgacgtgtgaagaggcctgggcccccagagcctggggcatatgtgcaggggccctctcaggcagcagaaatgccaggccctggctagggggccctcgagggccatgggttttcctccccaaaggccacaaccgtttatcttgccttccacctcacccttcgcctcaatggctcctcgcttcctctcctcgcttctcactcagcccccagcccctgaccttccccaaggctcagagctcagaccctgacagtcatggtccctctgctggcccccctgcctcagttcccctcctctgtgcctgccgttcctgtagttgccacttccttggtctccagattcttcagccctcctccccggcctgctttctctccagggcctggctctgcctcgcttctctgtattaacccatgtcttggtgcttctttctcttggggattccttccgacacccccaggctttggggtgctcctgatcccatgaatgcctggttgcccggggtctctgcctgcccaggaaccccgaggaaccagtctctggctagctgccggccctcgcagcccagagctgtccttgggggagccaagagtggcagtgctgccctgacggtgtgagaggcagccctctatgcagaagggccctagccaggtctgcgtgcctgtgcgtgcatgtgtgcgtgtgcgtgcgcatgcgtgcgtgtatgtgcatgcatgtgtgtgcatgtgtgtgcgtgtgtgcgtgcgtgtgcatgtgtgcgtatgggtgtgtgcatgcgtgtgtgtgtgtgcgcgtgtgcgtgcgcgtgtgcgtgcatgtgtgcgtgtgcaagcgtgtgtgtgcatgtgtgtgtgtgcgcgtgcgtgtgcgtatgctgcactaacctgccgcttgctgactgaggtttttgtctgtacacaggcgagtgagctcagggggccacctgcgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacct

SEQ ID NO: 371 - DNA, 3310 bp, Homo sapiens
agagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcaaatccaggagaacagtgtggagtttgaagtctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcggatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggacacagattcagaagaacagaccctcccttttccagtgccttcggaaagattgccgctccgtagaatgagtcctttctcctccacccttaatctacaacccagcttccccgggagatcctactttgatttccgatcctcaccccaccagctgagcttgcattcctctttacagtctctcaatgcaccgggatgcaattttgagacacaatctgcaccttactctcaattagttgacattaaaaagctgttggcagtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggtaagcaccctgcccctgaggttaaacagctgttgctggctaccggttcaaaggctgcccagggccgttcaatccaaccgaagagagggaagctgacagcgtaaggcccagaccaagatatgaaggagaggaggagagaaagggatcagcactggcaacttattttattccactaagcataagcaccttctttatacttggacgcagactagttaatagcacataggaaactagaattctcttcatggttggctaatgatcatctctgtagctctagtttcacctctaaatagaaacgaaagcctttaaccaactggcatgaaaacaaatagaatgacttaacaaagctcaggagtgcctgagaagaggtgagggtgtaagactgaagcattagtatcattatcagaaaatctgagcatcttctctgcactcttgtttggctctgttaggtcctaaggggtagaaaacatagtccctacctacaacttagtcaattattatttattatagaataaaacaacagcttctcatttattcattcagcaaatatctatagaatgcctttaatgtgccaggcacagttataagtgtctgggatacatcagtg

SEQ ID NO: 372 - DNA, 2393 bp, Homo sapiens
gatctcagttttatcatgaatgacttctccattgtgattcttgatttccttcatgggttaatttagaggttatgtatgtatgtctgtgtgtgtctgttgctaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcattcattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataattttt

SEQ ID NO: 373 - DNA, 2730 bp, Homo sapiens
cttttaggagagcactgctgcagccggcagtggagagcctgggcagggggacagggagaaaactccggcagtagggtggtctctagggctgacctcggagcctggggacaggggagcctatgccgcactgaaggcgggacgctactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtg

SEQ ID NO: 374 - DNA, 2028 bp, Homo sapiens
attttggagggaggaatcccttcctcccggtgatccttactcatattctagccaccaaccacggttagtgcttgcggattgccgtgcaggagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctagacaagagactattgaaaagtcagggtgttcaaaatggcttcagatcttatcaggacaatcttggttgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatggtggtggatcttgggaggacaactaacattttatgccctggctacagaatacagttgcagaggagcataaagttcaaaaagatcaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaaataaactatacgt

SEQ ID NO: 375 - DNA, 2306 bp, Homo sapiens
gtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatggccagccactggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttg

SEQ ID NO: 376 - DNA, 2399 bp, Homo sapiens
attttaaagctaaacaatggagaagggtttgagaagaacccaacaatgtgggagtgctacagcagggaaccatgaaacagaaacagcaagatggaggcagccagacaccaaactgggaactcagacacccagattccctccatggcctcacccctgggcaaaatccaactctgagccatcttcttcctccatctctttcaacccccacaggggctgcctgctcttcacagctgtggaggtgagggtgggcgtgggcgggatgctgttcagctgcagactttcttcctgggacgaggagacgtcctctctgttaggcttggcaggccctgccaagcagatgcatacattaaccacagcccagggcctgcgacaggtgtgctctctttccaagacctgcccaggatttagtaagggaaagtcaatcaggaagagaatggaaaacttatacagcttcattctgttgccctcaaatgggcatagccctatgtactaaatacatagccctatgtaccaaaaagtaaggcttagagaattgtagctaggccttgtccaagaagaacttgctacacagcctagaaaacaagatggaaagatatataaatatacatttcacagataaactgtaacaggtgaacaggtgaacacaaacatgagggagggttggagtctctaagattgagaggtctgagttagccaatgaagacatctgagatcctatccaagatttctgtggtcagaaaaagctgtaaatggcaatagagttttggtaccagaggctagagtggacaaatgagggccagggaggaactggaaaatgggagacaggattttctaaaagctagaaaaaaatgaagtgattgcaatgccagtataactgatatgatatgaagggggacttatctcctgcagagattggagaaggtagaggaggagaaagaatccaaagattctcactgcctgagaaaacccaggcaatactattttaaagcatcagtcaaattgacattaacatctgttaactgtaaacagtcacactcccattaccccccttctccactaaaaacaataatcccaaagtgagcgctcagcctatgggtttaagcagagggctacagaaaacagggaagagacatacccctgggcttggattcccagagaggaaaccttggggccccagatgtgtcctcctgatctccctgagctattaatggtgtgatgcccgagggctgggcccttgagtctctcctcttctccatcttcactggcttccccagccactcacgttcatgtccttaaatatcacctatactctgccacatcccaaagggatctcaagccttcagctctcccctgaactccatcttaacagcccccatggtttgttcaacatctccacctgtaatcctgtggccaacaccaatgccccaaccttcccccacagctatcttcactctctgccttccccatctcagatactgtcaactccgtccttctgtcaggccaaaatccttggagccatcctcaactgctctttttgtcttacatcccacatccagtttgtcagaaaagcctattagagataccttgaaaatgcacccagaatctggccgtttcttggcacctccaccattgcccccggcctaagaagctctcttatcttgcatcttgggctggactcctacaacagccacaacttccctgctggtctcccagcttctagccttcccccatctcctgtcgttttcgacacagcagccagaaggatcctttaaaaacagaggttgatcctgtcgttcctcaaaatcctccaatgcttttcctactgcactcagagtaaaagccagtctctgccttagatgctctgggatcctgtaccctctttggtctcatgtcctacaatctgcattctggccataatggtcttctctgctgttccttgaacattccaggaacattccccccatcccctcgtggcctcaggactggctgcttcctttggtatgctattctgatacacactaagcaccctccctcacctgttataaaaaattcgctgggaggccaataggctgaaatggctcctgcactttgggttcctaagtcagcaaactgaaactcaactcagagtgaaagtgttgtgtgtaacctaggagcaggaaacttcagcttaaccagtcagaaactaccgactaacctctaacaagagatttatggtcagttaacctctaaatatgaactttccactctaaccaatcaaatagtttctttgtcttgctcccagagacaccttgtaagtgtcccctctggtttcctcggtggtggcgccctgaactgctggcggtctgccactgcctgattgataaaattgctgaatgctcaaataaacctgttaaaattgt

SEQ ID NO: 377 - DNA, 2607 bp, Homo sapiens
agccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccgagccccagctgcacccatcctataccgacagttagacctctccctctttggtgctaccatagcatcttctcacttctttcatgggactttatcacttgatgattctatatttcttaatttcacccattagattgtgagctccttgagggcagggacgatgtcttactcatgtctatatcttgactcctgtcacatttttggataaataattaatgctcaatccatattgctaaatgattaaaagtacatgtcaaatggtcaaaaaaggaacactgtctgctttatgtcatattatgaaaataaacaagttattttgtgaaaagtgatagcttctcagagggaaaaaaggtattgcatttcttttacttgtgtgttattagtcatatgaaaatacaatgtttttatgtatgaaatggctgatttgaaagagtatataaacatagacatactgtgtttgccttttttaaaaaaagggctgtttaaatgggtcctaagataactttttgataatgtaatattgacatgataaaattgtaaacttcataattctggcacaggaacaatttatgaaaacatactaaggtatttgtaaattgatgaaataatatatatcttaggaaagtcataattattacacttgtacatacccttaaaataaaagagcctgcttgaaatgttgcaaaaagaaacagaaatacctgctaatatgcccttctaattaaggatgatgccaattaatctctttatataaataataaactttgagttgtttt

SEQ ID NO: 378 - DNA, 2527 bp, Homo sapiens
cagctgcccagcgtgtcagtctgcgtggtgcatgccaatggtatgactgtttcatgcaggctaggtaccgagcaccagaaatgggacaaacagaggggctgacttggctctgggatcaccacctctgaaagctttgagccatggagtatgaggccaggatgaaagagtgattccttgaggtggtctgtaatcactcgtggaggtgggtaccatgcgggcaaatgctaacatgcatctgttccccactgattctggaagcagaggcccaccctacaggtaaaccagggttgactgaggtcactgtggatgtctatggagggaccgtcactgcttcctctgtgttcttctaggtacatgtggggcccatgcggggcacgagtgtgggctggctcaaactgagaagtgccaatccccaagaccaccctgtgatccagcccaactacttgtcaacaggtacttcacccacctgtgtcttcctgggcttgaacaaacgaatgcctttgtggggttcctgtttatccctgaatcatacccttggactacactttctaggacacaagtgaccctctgtcgtcccccaccgtgtcactttaggctgtaaacttgcataggcagccccgtagtgtcctgggacacatgagataaatgaagtcccagggtttagacagtaggggagattttcagctttcagaacaatctgccatgatgtgcagggagaccacgccatgcaggtgccaggtctgtaggtagagcatttttcctgttgtcactctgagcagtctctaaaagcaaattccattcctgggcctgcctctttgcatgcagcaaaaacgagcactacccactgggcaggttttgcccagcagtggctgcagggtgctcacagccccactgtagcaggggcagggtgtgtgtacttatccctgccctacagataagtcagatccctgatttaaacctgggcctctgggtgggctgtgtccgtgtaggatgctacctttgagctacacggtacagtctaacccgctgtgggcagggacaagcagcctgctggctcagtcccccatggccctgaactttgtccccaaacaccatcccctcagacagcttacagagcctctccatgccgtgaatcttccagtgaggccagcacgggcaaaaggaggggtcctcacctgtttcttctcctcgacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccagcattcagcctgagatgttcctccctgcctcctggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggtgacagggtgagaccctgtctc

SEQ ID NO: 379 - DNA, 2291 bp, Homo sapiens
gagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcatcagaggcattcccctctggttgtacagcgacagctgggagagaaggcagcagccctgaaggcagttcctcttacaaaagcctccagatgatctaaatctagttagcaatgtcagcctgtggactgcagctgtttgggacattgtattcctttgtttgtctcttgttgttctgaaggattgtattgatcgcaaagctatatgcataaagattctcattgttgt

SEQ ID NO: 380 - DNA, 2542 bp, Homo sapiens
gctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtgattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtctgaggcagttgttcagggtgacttcacgtggcttctgagcaggtgtggttttggttggccctgttcctgggactcctgctctgtgtccatgagggtcctggagcatccagatggagaggggcaatgccctggtggtgctgcgcagcctgctctggccgggcctcaccttctaccatgctccccgcaccaagaactatggctacgtctacgtgggcactggcgagaagaacatggacttgcccttcatgctatagaatgggagccagcctggatgtttttaaacagagtctaaacatgattttcttaagcttcagtgaacttggcctgcctgttctgtcctatcttcttaactccacctccgtctggttccagattctgaaaggcccactgagccagggagctcatttctaaaccaagtggcagaggggttggaatgtgctaatgaaagagattctagacaacgatgggtggaaatggctgtgggagaaggtgacaaccagggcccctttgaggaacgcagtttcttggattcacacgagagcggcaagtgtgtcaggcagcccaccttggctccctgcagctctcccacagtaaggagctcacagctgtcatgaagaggatgggacctgtttggcccatgaattcaattgactcattggccccatcacaagagatcagtgactcaatgctcagcacccagctggcaatgtgcccaggaccccctgcacttcccaagcagtgagcgcacacccaatgggtaagcccatgaacccagtttatgacactgcgttgggcaaaactcctgtccccagcactgagcatggcctaagccccatagcagctggcaagggacccaactgccctgcctgcctctagctcccagcattgctactgtgcaggccaagggtactgaagttagtcccactgtcccctgtccatgcatgttggagggaccaggccatcgtggtggggtgggacaggagtatagttgtggccaagggcttgtgagtgggcctcctactccccagcacaggtgcaggaggaactctggaagcactgctctctgtcagtgatacagcttccaaggtgttcttgagtagcagacattgtccctcagaaggggtgaccccacgggcatgcgcaccctgttccagcgggggccttttttgtagatgggcttgacggagccaggagcccagcgcgtcaggtacctgtggagggagaacaaagaggtgcctgtgagggctgggggcccaagctggacgtgggagagtggagcactacctcctcaggccaggccacggttgggcaagcaaatcctttcaccagtttccctttcctgaagtgcagggattttcctgggagtaactgctgagcgtcctgtaaacagatgggctgggctcttgctgccgcaagcctgtgtggccaggttcaggcagcccagggccacaagctcccttgatctttgtaaatgtcaatgttggtgtgtgtttgctgaggaaaaggtggcgaagaggctgcctgaagagcagatcattcctctctggcctcagccatggggcgagaagagctgatgtaaggctctggaggaacccattgctcttccccatttggctcactcagctaccccaaccttcagggaactccccagggtactataactggtataagacccctgcccctcacccaacctgtgatgggaatcaaggggtaagggcccgtgggcgcagccctagcctaggaaggttcctgtaaataggaggggggtggggaaagatggctgccgcccatggacctttggcctcctttggggatggccagggccctgatagttcccagaaaagtggctcatgccggctaggattgggttttactctgtccagaataaaacttggatcctgtcc

SEQ ID NO: 381 - DNA, 2067 bp, Homo sapiens
gagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttcattattgtttccttagggagggcgtccctagagctcagtcttctgccaacctgaatccatggaattcgagttggaagaaaccttagaatctgcctgatcttctctcctcatttaacatgtgtaaaaacagaagaacagttgtgtggcttgcccaagggctcctgaatgagacaggaccttggcctctgcctcgggccagaggatgtctcaacaatcagaagtgaacacacagcatggctgggtctcgagggcatcacgctgagtgaaaaagccgctccgcagaggtcacacactggatgtttctagtgggagctgaaagtctctgagtgacccattcatctggatcagaccaaggctgccagtcggtctttctgtgatagctgaaatttgggagtgaaatgcatgtgaataaaggacatttcctggtcttgggggtgtcacaaaagatccaagacattgaccttacctgactagttgatctttctaagaccaaatcaaatctcgatgaatttaaacctcaagataaagtgaagaccttaggtaacatatgatttcctctaacaattagtctggcccatcaagcagaattgagataaatacacacagccagtgtatccttcagcaagcctcttttaatgatttaaaaaagaactactaacttttacaaataattgtgttcagagacagactttcaatctaaagaaaagatcaaggacctagctctcgtggcagaatgcagaaacagaagcctccagattgatctctgcagatgctaacgtggcccactttgtcctcatattcagcctgatcctaaagcccttacaactaagccaatacctgcttggattcttctgacaactggcaaagatgtcacgttccacttcttatctcaccacctcttaaccacaaattggccccagtggctttcaaaagggggaaaaaattgtgcgagtttgagactgtttatgtattcatgactaaaaccaaatctgagatctttggaactcttagctggccctggggcatgcgagccgcctgtgcatccctttggtccacctggaggcccgtgaagaccttcagtggaaggaagagtgggtcagatgagacgtgtccatttcatcagtcagccatcggtgacaggctgaattcagagacccaggccagagtgtaccagctacaaaatttatccaaggattccaattatgctttaaaaaattctaccagaagaagtaaaaaacgatgtttatatgttaagaaatgtaacagagtagctctcatttgataatataaaatagctctgcctctattc

SEQ ID NO: 382 - DNA, 2733 bp, Homo sapiens
acctgccatgagaaggcacattgagaagccagccgtctgtgaatcgggaagggagccctcaccagaacccagcccagctgtactctggactcgaactcccagcctccagaactctgagagacctggctgttctcacccttggcccctgattcctgcagcgtgaatcaaatctaaagtcttctggttccatcctgttgtgtgggaaacacaacccccttcctctgtggcctccttttccctcctgctggagcaccgctgctaggcctgatctgcaaagctgcaaggttgtttccagcactttgggaacttaatatgtctacagctttcacaccaggctgcccctcttctcaaaagacatctgaacctagcacaggttaattagatcattatttcaagagacaaaagctacaagaagtccccagcagcacacacacatttccagtgatgtcagactttaaaattgtttgtatttattccctaaagaaagaagtgctgccacagtgaaattattatttttaaaagtgctgcaaaaatattttacaaactttaccttcaactgtgatttctccctcttagcaattcataattatatattgccttctccaaattcccaacctactgattccattcctaacagtgaatgaatccttctagttcctttcataattactttagcttttctccagaaaagctttttgttgttgttttacttcgtggaaacatatggctgatggtggggactttactgtttcctaatttgaaaaagaaagccatcaacttccactcacctatgaatggggtatttcctcgtcgatggtcacatcagaagaggggcccaagtgtgcacccagcatgtactaaaagccgcaagtggagagctggggccatctgcagcagatggccccacacacagcgccaccatgaaaggccattggaaacaattaactccattcacgctaagcagaaataaacaatcacccattcaagtgagaattagttccactatctttctccaagtcatcaaaacaaagctctccgagttgggatacctcctaaagtaccttagcagcacggaaccacacaaacatccccttgcttgccgatttctgtaacccaagccagagataactcgacatttgcattactaattgctctcttccagaacttgttgacgcttgggttggttttgaatagaccgctaagtggctctccagacataagcagggcccatctcaccaactgcaaacaagctcgcctatctgtcatcaggcggctatttctttgctccaagaaatagacagaaagtcccctgaacactctagagggatctgtttagatgaagagcgtgggcggccaccctccctcctgcttttctgctctggcgttggctcttgatgctgaagggtccatgcaccacacccgcctctctcctgcaggaagtccccagccctgggagcccacgcctctcccctcgtgccctcagtgggcgccttccctatccatcagttgcagggacaggtcttggtgctggcctgttctccataagcctcccctgctaatgcgatgctatgaccatgcggccactgcccgctttgtcctggtactccccaaaagactcgggtttgaactgcggaaacatttaggtgagggtggaagtgcaagtcggtggcataattaattaagtgattgcatttatgcggctcctctgcttttgagtccaatgcttagaaagtgaaaggatcttagctgtgtcatcactagcatcacaaatggagacaacggggcgtgtagggaaaggataactgagaagaagatacaacaagcaggagctgcacacggcagggccgcagccgaaagacgccccagcagcaactggcatcaagattcctcagactccatgagtcttgctgccaggggatagggtcggggtgagaagaaacccctaaatcgagacctggctgccttttgctggccaaaccaacccccacacaaatgtccctaacttcatttgttttctaggcctgtttcataatctgtgtttttctccggcttaatgcattcttccccgcctttgccagatatccagtagtgacacaataacagggacacaaaccagcattaaagggtaattacccacacggctcactccccgagcagggctgtggagacacgtctctcctctctgttcccttccccattcacctccctgcaaaggctttctctaaatcctgcctgtcctacaaatctcagattatggttagcatccttcaaaaagccttccgtggaggcgcagcccccatgctccgtgggtaaagagtctgggcatggtaccctggtggcatgtggctcctgtggtgcttggcaaggggcggcctggccagtgtttcatttgtcccttttgccgctgaaaccggaagctccttgagagtatgacccttggatttccatccccaagacctggtactccctgtgtttactggcactccatgcatgcttgctgaacacatgaatcgctgacttccttctgctactcatttggaaccagaaaatctaccttatttttgtttccattttcttcatctcgaaggtgaggggacaatagccttcctcccaagactgtggaataaataagagacacatcgctccaaaacattttttttcgaatgtttccactataaaagaacagctatataaaatgacttgacaaatatgtaataaatgtacttgcaaatc

SEQ ID NO: 383 - DNA, 2404 bp, Homo sapiens
atttacaaaccttgagctagacacagggtgctgattggtgtgtttacaaaccttgagctagacacagagtgctgactggtgtatttacaatcccttagctagacataaaggttctccaagtccccaccagattagctagatacagagtgctgatgggtgcatttacaaaccttgagctagacacagagtgctgactggtgtatctacaatcccttaggtagacataaaggttctccaagtccccactagactcaggagcccagctggcttcacctagtggatcctgcaccagggccgcaggcggagctgcctgccagtcccacgccatgcgcccgcactcctcagcccttgggcggtcgatgggaccacagagcagggggcagcactcattggggaggcttgggccacacaggagcccacggcagcagggggaggctcaggcatggtgggctgcaggtcccgagcccggccccacggggaggcagctgaggcccggcaagaatttgagcgcagcaccggtgggccggcactaatggggggacccggcgcaccctctgcagctgctggcccgggtgctaagcccctcattgcccagggccagcagtgccagccagccggccgctccaagtatggggcctgctgagcccacgcccacccggaacttgagctggcctgcaagtgccacgtgcagcaccagttcccgcctgcgcctctccctccacacctccccgcaagctgagggagttggctccggcctcagccagcccagaaaggggctcccacagtgcagcggcaggctgaagggctcctcaagcgcagccctatgttgggcacccaggctgaggaggcaccaagagtgagcgagggctgcgagggctgccagcatgctgtcacctctcatagccatgaggaactgtgccatgaggaatggtgcattccggaccagatactacgcttttcccacagtcttcacaaccacagatggggagattccctcggggcctgcaccacaagggccctgtgtttcaaacacaaaactgggcggccattggggagataccaagctagctgcaggagttttattttcataccccagtggttcctggaatgccagcaagacagaaccattcactcctctggaaagggggctgaagccagggagccaagtggtctatctcagcggagagcccggaaagctgagatccactggcttgaaattcttgctgccagcacagcgtctgaagttgacctgggatgctccagcttggtggggggagaggcgtctgccattttggaggcttgagtaggcggttttcccctcacagtgtaaacagagcctcctggaagttcggactgggtggggcccaccgcagcaccacaaagccactgtagccagacgacctctctagattcctcctctctgggcagggcaattctgaaagaaaggcagcagccccagtcaggggcttacagataaaactcccatctccctgggacagagcacctgggagaaggggcggttatgggcacagcttgagcagacttaaatgtccctgcctgctggctctgaagagagcagcggatctcccagcacagcactcgagctctgctaagggacagagtgcctcctcaagtgggtccctgacccccatgcttcctgactgggagatacctcccagaaggggtcgacagacacctcatgcaggagagctctggctggcatctggtgggtgcttctctgggacgaagcttccagaggaaggaacaggcagcaattgttcctgttctgcaggctctggtggtgatacccaagcaaacagggtctggagtggacctccagaaaactccagtagatctgcagcagaggggcctgactgttagaaggaaaactaacaaacagaaaggaaaagcatcaacatcaacaaaaaggacatccattcagagaccccatctgaaggtcaccaacatcaaagaccaaaggtagataaatccacgaagatgaggaaaaaccagtgcaaaaagcctgaaaattccaaaaaccagaatgtctcttctcctccaaaggatcacaattcctcaccagcaagggaacagaactggatggagaatgagtttgacgaattgacagaagtaggcttcagaaggtgggtaataacaaactcctctgaactaaaggagcatgttctaacccaatgcaaggaatctaagaacctcgaaaaaaggttagaggaattgctaactagaataaccagtttagagaagaacataaatgacccgatggagctgaaaaacagcacgagaacttcatgaagcctacacaagtattactagctgaatcaatcaagcagaagaaaggatattccagactgaaggtcaacttaatgaaataaagtgtgaagacaag

SEQ ID NO: 384 - DNA, 2270 bp, Homo sapiens
aaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaagggaaatgcatttatagaacattatgatccaaaagagtatgatcccttttatatgagcaagaaggaccccaattttctgaaggttaccatcccaccatttcatgaccctttgaaaaaagcacaatatgacaaggataatgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaagaaacaaagggtcatcctttctagaaagagaaccgctgtgctatcaggagggaaataatccaagtgccaaagaggccatctctgaagggtatttttcttccttgagcctcagccaggaacgggaggaagaccaggatgggtcttgttctgtctcccagctggagtggatacaagcatggcttgcttcagcctcaacctcccggactcaagcgatcctcccgcctcagcttcctgagtggctgggactgcgggtgcctgccaccatgcccggctgatttttaaacgttttgtagagacgcggtcccattgtgttgcccaggctggtcttgaacacctggcctcaggtgatcctcctacctcggcctcccaaagtgctgggattacatgcatgagccaccatgactggcctagactttttgatttaaagagactttttggatagaaatgcttttctctattacagttataaatgactaaaaatactagctatgccaaaatggcaaccagaggccgactgcaaagcttcaaaaggcttgatgctctcctggtagacaagtcttcagtctcttaaatgtttttttcatatgttgacattgaaatttcattttgtgtagatgttgggattatgtctcattcatttatttattcatcattcacttagtaagtatttaagtgcctgtttttcccaggtgctctgccaggttctggggatataaggatgagccaacataggctctctgccctaaagttagtgggagaaacagtaacaaaagattttaatactatgagattaactgacttagttgtggtatgtagaaagagacacagagcctgcagcaagagcctaggtgaagactcagtgaagcactacctattgaaaggagaatctttcaaatccttaacagttattttcaccatgtaaaaaaggcgacattgccagggaacatcaagtaaagggacaaatgctcagtcagagttttcgcattttcctgattggcccaaatgttttgaagtcggtttcttcacatcagaatccaaaccaggtccacctgtggcaccttcacccttcggagccggacgcgtcacttaaaaccattcctcttacgttgtcgccctcaatcttacagggattctcctgtccatggctgccaccaaaactgcgagttatgatgaacatttcaggccagaaaagttaagagaatggccggagcccgagtccgtttctttaatggaggattgtgacagtgcctgctttaaagcaggcgttgaaggggaatgttcgggctcagatttggccgagagtgtggccaagagtgtttccagtcgccagcctgggggctggcgcaccgacgggggcgggcagccgggcgggtgaaggcagccaccccagctccccggcagaagccaggtctgggcttgccagtcaattctgcatacttcagcgtctggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagac

SEQ ID NO: 385 - DNA, 2351 bp, Homo sapiens
gctaggagtataaaaattagccaggcatgtgccaccacgcccagctcatttttgtatttttagtagagacagggtttcaccatgttggtcaggctgctcttgaactcctggcctcgtgatccacccaccttggccttctaaagtgctgggattacaggcgtgagcaactgcgcccggcctactactctgttttacagatgaacttgaggttcagagaggtcaagtcatttgcctgaggacacacagcccaactctgccttttaacactgaccaggcaatggagtgggagtgatgagaatgaagtggtggctcttctgggaccagaggacagttccaaagtcccaggcaaggggagttccatcttccagtcctgcctcctggtcgtcagctgcgctgataggggcccgagtaggagttctgaggctccagcctctcaggccccacttgccccacccattctgcttgcagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgtgagtataccagagtatagctgactgctcacctgccccatccacctggcctagatctggcaggagtgggggtgtggagtggtgcagccagagaggaaaacatgcagctgaggagagagcgagctttgcaagatggtggtgaatgttcactcaacaggtatttggatttactatgcaccaaaagttggggttctgcagtgaatgagccccccagtcgagagtgagaagcaggaaaaagcagggctgggtgaaggtagcatctatgtgactgtggaaggagaaccaaagagaccgcagacccagggtgggaggttggattctcacctctgcacagcctgacacccatttccctgcaggagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctccgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggcccctcccggggtgggtgggaaggctgatgatctgtctccagccccttccttctgcccacccgcccttcttccctctgggcaactggacagatctgggagccagcagctggatgctgtggctggccagagacacccccaggctgtagcctgggggctggggggagccccaggctgaaaagggtccaattaaaacaaatggagcc

SEQ ID NO: 386 - DNA, 2618 bp, Homo sapiens
actttactgtgcagcagaatcctctggggagctcttcacaatgtagatttctgggcatcacccatctacaaattcagactcttgaggtgaaaccaggaatctgcagttaaaggctcccaggtgacttgggttcaggtggctttcagaccactcatggggaaacactacttcaggggtgccccttgcagtagtgcctctgtctcctcacctgcacccaccggaccaggtgtcacccacactttcctcggtatcttgcacatcggtcctcttgtatccatcctaaggctctcaccccgcttctgtccgtgttaactcatgttcattcccaacagactcatccctaggctctcccccaacaacccatccttttctgcaacccctcgactcccctcacacacaggctaatctttctctttccagtgtcttagacttactagtgacttcttggccaccgttggtgctcctgttgaatataaccgcagatgccaagggccacagccgaggaagtggaaaatctgcacgggcccagtaaggctctatctaaaagacagaaaaggatttaggaaggagttgcctttcaaccagcaaccaggcacaggcagaagagacattagagctttgtaacaagggacacacagagttggcagcacaaagggcctgggcctctgaaggttggatgaccaggctcatcatccatccagggatgaccgagcctgtgccctagactattggcctcccacagcagccagtccatctgcccagcagtccctgggcacccaggaatgcagcctacacggcatgagcgggcaggctgggggtatgtgtggcaggaacagaattggggttcttggggaggtttttttccacttaaaactctttttgtcgcctacgtctccagacatttaaagatttctgagctattttcagacctactatgaaaagaactgaggtgccagcagtcagacacccatcgaactgtttcctaagaggagaactggcatgactcacttttgatctgtcagctttgtattgatttttctggcaaactttgtaggtctgcccagggttgactccaccaggagcggctacgttgtaacccactgcgtccagagtcagtcattacaaaggccaccatcacaggatcggattctgcatttctttttgtgggaatgtgggaggagaggagggaaaccacaatccacaaaaccaagggtgtccctgggcttccccactgcctgctgaagggaagccaggcagctctctacatgcctgtcctgggctagggactgagggctacttttggaaagagggactgatgggagctgacagaggcccagaggcaaaccatttccaccctgtcctttcctctaaactgggaaccggggagccagcgattggaggctcagaaggaggatggtgaggttttatgcacagtttaaatatattgctatgtaattttccaattttaaaacatgagatcactgattattcagtagcttccccatttttttacaaagccctcctgtgtgtatgtttgtgtgtgcgtgtgtgtgtttaaagccttttcagtcaaactgagatatcctaccgaccttcccattgttcctgagcccccatgagaatgtgtagatgtgtgtcagagctttagagcctgcaaggagctcccgagtctgaggactcacttgtgctgatatttcagggaagagcttgatgcctagaaactggaatgtgcagatgttgcatattcagagactgaagtgctggcctcagcaaacaatgccaggagaagaaccaagaggtggaaccacgtcaaccaggagccattgtttcgctgagggcaaagccatttgccaggccctgtgctggctgccctagccctcagtgcctcccctcaactttcctgtgggtgccctcaggtgaaacggcccctcagacagcccctcaggagcaggtttgacatgtcactgagagatgcatatgtgtgtgtgtgccggtgtgcatgtgtgtatctatgtgtgtgtatgtgggtctctgtgtgagtctctgtgtgtgtgtgtgtgtgtccattatgtctgtgtgcctggatgtctgtgtgtttctgtgtggccatatggatgtctatgagtcttgtgtgtatctgtgtgtgcatgtgtatatgtgtctgtgtgtgaatctctgtgtccacgtgtctgagtgtatgcatgtgggtgtgtctgtgcatctgtgtgtgtctgtgaacatgggggtggaatggaaggggacagcctcacccgtggggagaaggggatggaaacagctgctctccagagctcctggtagacatcacttccacagagaggctttctctgcactccttccaatttaaattctgctttctgccagccaatatctctccctcgtgttgtctcactgcatccaatgcttttccttcttagctgttattgtaatttgtcatttttatttattgggtgatgtctgtcacccccgctagtctggaagctccatggatacagggatattttatctccagtgcccaatacaatgcctggcacagaataaatgctgacaaataataaatgaaacgaggtcagaagggccttgtcattgcccttctggat

SEQ ID NO: 387 - DNA, 2203 bp, Homo sapiens
gtggcaccagagtgagggctgggtagaggggatggctggtgatagctgaaggagccaggcagcggggaggcagagaaagaacttgttcttcctgctgctgagacgagagaaaggaaagacgaggcagcacttgcaggaaaaggaaagcctaaatgcagccatgcagggaacaacgcagccatgcagggatgccctgtgctaagtgctgggcatgcaatgagactccatgaagccacagtgtcattgaggggagacagaagacacacttgtcaaagggcgcctcgcgggagacagctgcacagcacaggcactctccctcagaaaccgctccttcagtaagaggtggtggcaccatccactcgggcagggagactgccgccaggctgagaacttgcaaaatggaaagaagtgagaacagtcctatggaagcagcacagactttggaacagagttgtaagatgccaggacagagcaggtactcagcacgcaatggtcattgttttcactattccggggattcaactgcaaaggaagaaaaatatttcatccaagagtggacaagcaggcttaggacagaggtaagaggagaagagagttggaggatagtgtttctgaagaaggctaattcccagggaggacttctgggaccttgcttaccgacgaccgaggttcacctgggtgtactgggccccgcactaagtagcctgtgtcatctcagtttatttaatgctctcaactctgtaaagtaggtggtattaccttcatttaacagatgaagaaactaagatgagggctctggcccgaagctggtgagaggcagcagcaggaactgagcctgggcctgctggactccaaaagcctctctggctctgtcacttgcactgaccccaaggcccaagggaggtgaccctgtcaagtatggtggaggactcaggctctgcaatggcagagatggtttgcaaagcaccctacacttccctatgctttttgttccctacttgttttaaattttatctgataaaccaaatccttctctgtatttcctgttttttaatttgtggagttttaaaaattgtgataaaatacacataacataaaatttatcataactattttcaagtgttcagttcagtagtgttaagtatatttgagttgtgaaaaaggtctccagaaccttttcatcttgcaaaactgaaactttgtacccattaaacaataaccatggaaagcaaaaccacagataaggaggaattcctgttctatgctattttgattacagtgactttatgataagttttgaagtcaggaagtatgagacctccaacattgttcttttccaagatcacattgtctatttaaggtcctttgatatttccatatacatttttggattgggttttcctctttctgcattaaaggactgcattaatctgtagatcactttaggaagtattgacatctgaacaatattgtcttccaatccatgaacatgggatgtctttccatttatttatgtcctctttaattgctttcagcaatgtgttgtacttttcagtgtacacatcttgcctgcttggttaagtttattcctaagtattttattctttttgatgctatcataaatggaatagtttgtcttttcagattgcttattgttagtgtataaaaatgcaataattatttgtgtgaattttgtctcctgcaacttcactgaatttgcttattagttctaaaagttttaaggtgaaatgtttacattttctatacaggaccatattgtttacaaatagagttaattttacttcttacctctgacttggatgccttttaaatttctttttcttgcctgattgctccagctaggactcccagaactatgttcaacagaactgatgaaagcagcatccttttcttgttcctgatctcagaagaaaagctttcattctggcatcactgagtatcatgttagctgtgggcttttcatatactgcctttatgatgttgaggtaatttccttctgttcctttgttgagtgtttttaaatcatgaagttgtgttgaatcttgtcaaatgctttttctgtatcaattgaagtgattgtgtgttttttccttcattctgttaatgtagtgtgttacattgattgattttcttatattgaaacatccttgcattccaggaataaatcccacttggccattgc

SEQ ID NO: 388 - DNA, 2351 bp, Homo sapiens
acactctcccacgacaggagaccagatacgcatttcacttctttattggcagcccggagcctggtctaggctctcccaggcgcttacacgtcccaaccccagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggc

SEQ ID NO: 389 - DNA, 2246 bp, Homo sapiens
ctgacctgccccaaagttggctccatcctggacaactcggtgagaggcagtgggcaagtgatcttggagatgggtgggcaggtgattctgtgggcaggggatgtgctcccctgcacctctggggtgcagaaacctcttgcctccagatttgggtggagcctctgtgggaaccataggaagtgtgtgggctgccttcctgggcaagtatttcccagtgggaagttggagggggctttaacaaagttttactccctcccctgttcccctgatctagtgctcaggacccttcaccatcaggaattccttcctgtcatctaacctcagtcctgcctactgcagttccagccaacctgctctttcctgagttcaaagcaggtggagactggctggttaccatctttgcactggcccttcggagattcggggactcagttctggtggggtcaccctccctgtcctcccgcctgtgggagggagggagggctggctcaggcatcgtctcccgcaatgggcagagagagcagagacaggtggaccaacagacagctggcccctggaggcagaaaggcccttctaacttccagattgtatgcttgagtgatgggtccccagcccaagcccactcttccctcagctcacccttcagcctgttccttcttgccctgaccccagcccgtgcagctgctctactccaggaatggatgtggggactcttcctgggttctggctcctgcatagctcaccccacctcatcatgagcctcaactgcctacatctggggcaagcagcacaccggctgcagatgggacagccagccctgcctatctggacaggcccctgcagcctctgtcccctggcctagcctctctgtccttccctgagtcacagagagcaagccaagacatccagggaaagaggaagaaaggccttagtgtgccccagcagtctggctgcgtccagccaccatcacccggaaggatgcccacaaggcagctgaccctgaaagcagcctccccctcatggagagtcagcagcttgggcagccacttccaggccagggtggtggcttctctgcagaccagctgaggggaggactcctgggtggacagcctttgacgtccaccccacgctgatgcagaagctcccagaacactcaggaaacttctccggacagagccctccttgtcaacttgaggccctcccaaggccctctactgccctctgggtccagcagagggagtggaggaagggccactgcctcccacctagagcttctccgaatgacaatcagctcgtgccaggtggggaccaggatatgactcctggtgcccaggctctgggcctgctccttgccaccaaccgaaccgtgaatgtagggcccccagcctcacctctgccccaggaccaacaacaccctggtttggagctgggaggaagaagggggcctgagagagccccaggtccattctacccccagcttcactcagcactggagctggcagagacgcaaaacccagtctgcccttgggattccaaacctccctagggctcccaactgacctcaggcctctgagtcactgaatgtcaccaggagaggtgggggagggaaagtgggccagtggggagggggtcacctaggggactgcctctgtgcctctccccaggaagcatccagggcagaggaagccacatctcccggtgcccccaaccccagctgcagcctcctccccctgagcattcattctctccaccaggcctccaggtcctgagcccttcctctgtaaaagtgtcacaccacctccctcagcacttccccatcacaacaacctatgtcactgactcagatgcagggtctgctcaccccaacacatgccttccctccccagccacaccgtgcacgaagggggcacaggagaggagaggggctgtgccccaggctccccatttcccagctcctcacagaggcctggtttgctcagtcttctgaactccagggaccagccctggtgggcatggggtggggagcagggagttgcccttcccctccctcgggaagccacctaagaatgtttacatgccaaacagaatgtaacacccctccccaagcccttcccagtcactgcatggcctctgcccatcctgcacctgtccaccccaccccaacaccctggaagccactgtcaatgattagatcgggtctcggaagggaagtagccatcacaccattaaaaagcctgtggaccttt

SEQ ID NO: 390 - DNA, 2477 bp, Homo sapiens
gttacagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggtccactattctccccagaacttcacagacaacattggaaaggccctggacatcctccatgctgaggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgtaaggactcttgggccccaggtggtttggggataactaggccagctccagatcccagtcctcttaacttaagggtctgcatgcctgtcctctgccttatcttgcccctctacctggctctgtcaatccaagagcatgccagttatttgatttgcggccactttctcaaacggatatgcagaggaaatcttttttgggagtgaactgaattgtttccgcgggcagagattttgaacacccaataacacttttttaatatatgtaaaaatatgtcattctgactcaaaattctcctaaacctccctgtgcgggcgctctttttcctttggattatgctttataatcagctgagaccctcacatctgtttcttctttgcatctgcatggaaagcagcaggactccttagttgtggatgaagctctgctcctaacttccaagaaatggggcttttttactatcccagatcatcactttccaggagcatgtgcaaggccttgagaataccttacagaatgccccagagggaaagaggagaaatgtgagacttaggagagatctgtccactgcagtcgcttaagacagtgtaacgacaaaggtaacccttacactcctggtttgagacagtataacgacaaaggtaacataggaagtcaaggagttcgcttcaccgcccctccccccaccccaccctttttttttcctgcaagtttctattcttcccgcagctcctacctcaaagcagcatggattcataaccacaggctcccctcattagggcttggggagggagggtgttggaatccacactgccagagtaatccagactaaaacatcaacaaatggtcccagctggttcaccaaggaacacttggcaaaacaaagaaatcctgtctggagcgacacgggcacagccacaaaccagtcaccaaattcccagcaagtatgtgctaagaagccaaaaattaaaaatacgtgagaagcacccacttgaaattggtggtattacatacatacactggctgtgcgccatggggtttttctgtaggaaaatgtccagtctagctagaacggcacccacagccacaccatgagcaaagccaccaaatacctgaggaagccacagtccatggcactccccatggaggcttctgaattcagaaaagatagattcctgtgacttaaacctggtccaagtcttcctaaaggacatggaactttgagctctgaaaagatggagaatggttaccaaaagcaatgaggttgtcgagactgggaaaactccatgcagatggagagatgagcatggtgaatatggggaccaggaaaaatgaggatggatgagccagatatgggttagaggacatgatggaaaggatgaggagttgatagcgattacattgttgtgatggttgtaacatcaggctacacttgactagggaatataaatgttagtgagaaaagatttgcacaaagaaaatgctaataaaagttgacataaagtg

SEQ ID NO: 391 - DNA, 2903 bp, Homo sapiens
tctttccgtaaccgtagcttgaggcacatttcctaaatatgcagcatggaacgcttggcggttctgaacgcgcatctcgtgctgctcctgtagggcggttaggacgcgctcctctggcgaggaaggtggcagcttccactgtgcacgggtcacaggcgagtgtggtgtggtgtggttgtgggtggggtgtggactggatctgcaggcttgtccctctctcgtggagagctgtcggggtccaggcagtgctcagtggtgagagccacagcacatttgaaagtccacatgtgtttgccccactgtggtccaggacatgtgtgagccacactcagtggacttgcacctgtgacatgttggtcagcgtggcggccgtcagctgggtgtggaatgcatctgattggagcctggcacccggcctaccatgattgtgattctctggggcgagtcctgagtgtgggcagggcctcaggcccccaagagggctgtgagcaggcaccttcctgtgaggcacgatgccaccatgtgaagttgtgtgggtctttggagagttctggcaggttgagggcctgtgcgtgtgggacccaggcctgccctgcctgctgccggccatgttccctctgcccagtcatgttgacaattgtggccaaattcaacatcgggcctgtttcctgcacccacgttggcacacactgagttcaagacagtttctgcagaaatgaatccagaggtgtttatttctggcacgttggatcagacgttcagagggtgggcgtctttctccatgcacttcagctggatcagtcagtgtcagccattgactttagcaacagggaaatgaaagactttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggtgggcacacctttgcgcaggcccagtgtgcgttctgaaggagagcccagggtggggttccgggactgaggtgcagccgtgtccagggtgggcttctagctctgccgctgggcggaactggggtaggtcccagggtggggttccaggactgaggtgcagccgtgcccagggtgggcttctagctctgccgctgggcagaactggggtagtcccagggtgggcttttagctctgctgctgggcggaactcgggtaggtgggagtcctcacttctctgcagggtggtgaagctctctgggtagtgtgagcagttctcaacgtgcaccttggaaagcgcccgttttgaggtttagctgtggccaagatagatgacttcattttgttgctttttgttcttaacatggggagatatttagaaaacatgtttggctcttgctggggaagcagtgctgttccgtacagtgttttacaagccgtgtttccttaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggttttgtttatttggttttggcggggagaggagtggtatttgatgctttctgtggacaatgtaaccctaaacacatcatgtattttaaatgccacctacataaataaaacataagcatattgaatac

SEQ ID NO: 392 - DNA, 2423 bp, Homo sapiens
attttttttttttttgctggaatttgttttctcagtactgaaaagagaaaaagtgacaatcttgtatttttaaaagcctcggaaaggtgataccatctgacagtcattttctcacgttggtcttctaaagtcacctatttcttgtgtgtgcacatcacaccatttcctgtttctttataacccgacaagggtaggagtgcctgtttcccctgctgggcacaccagacaatcgtaatcacaaaacagacactgagccaggggcccaaagggtgtgatcatgagagttaccgggacagcagtaggcatgacagtcaccaggaaggacaagggtgctctgttgttagtggccacacaccaatttgacaaggagtgttgcgaaatttttatttatttatttatttattttgagatggagtttcactcttgttgcccaggctggagtgcggtggtacaatctcggctcactgcaacctccacctcccaggttcaagcgattctcctgcctcagcctcccaagtacctgggactacaggtgcgtgccaccacacccagctaaattttgtgtttttagtagagatggggtttcaccatgttggccaggatggtcttgaacccctgacctcatgatctgcctgcctcggcctcccaaagtgctgggattacaggcatgagccaccacgcccagccaaaatatttttttaaagtcattttccttaagctgcttgggctacatgtgaaatacactggacggtcaacattcctgtctcctcccatttgggctgatgcagcagatccagggaatgttacctgtttctgctgctagaagatccaggaaattgggaaggttacctgacgcacacatggatgaaggccatcatctagaaatggggtcaaccacaattgtgttaattccgtagtgtcagggattcttcgggaaggtcaacagtatgaaggattctgacccctgtgcctcccatttatgtgatcaggtgacagttaataaccgtggaggtcacactcagccatccaacagccttacagtgaccctacacaaaagcccccaaattccaaagactttttcttaacctaaaggaagaaattatttgttaattccagtagagcaactgaatatactgggctatttgtacttttttatagagaactttaataataattctttaaaaatgagtttttagaacaaagcaactgacgatttcctaagattccaatgccctggagcttgtaggaggacttagcctgggtcagctggagcacccccgacctgatctcccactgccagattttcccatgctcctagggtatggagtccacgtgggaatgactgcaagttcaggtggaacttggccgactgatgctctgcgagtttttaatagacactggggacaactgcttaaggtttagaaacttccaaaccacaggaaagacattttcagtgtcccccatccagaggcagccctggaataggattcccaggggtttctgggacccctttccttgctccgtgaggctctgtggccatcttttggcaggaggaggatgcttccttggctctgtgcccagacccgcctggtccccaggtctctcaccttgggtgaagattcagagatgccctgtaaggattttgcccactgggcaactcagaaatacttcgatctcccaagatataagaggcagcagcaaacgtgcctattgacgtctgtttcatagttaccacttacgcgagtagacagaactcggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacctactgacaaaatgtagaggccattcaaccgtcaaacaccatttggttatatcgcagaggagacggatgtgtaaattactgcattgcttttttttttcagtttgtataacctctaatctccgtttgcatgatacgctttgttagaaacattaattgtagtttggaagcaagtgtgtatgaataaagataatgatcattc

SEQ ID NO: 393 - DNA, 3144 bp, Homo sapiens
tctggagtgaggctgagactccgccgtgggaatttccacacgggctgaagatgcctagcacttgggaggcggaggcgggaggctctgctggccggagagcacccccatcctcatttagacctggagacgctcctgtggtgccactttgccgccagcctgacgttctcaggaggtattttaatcggggggggggggggatgttttatctaaacacacaattggtcaatttcaataaacaaggggaaaattacagaataacaccgaaaccacagaatgtggttcaacaacttggcactgggggggtggcgggtagacagcaggggccggaacaggcccggggtgtcccatggcagtcctgtctacacccccaggccacatggcctcacacctgccctgtgtatctgtcatgcgccaggcagtacccacaagactcatactcactgaaagagcatctgcccagggccgtgcctcttgttgtcatggaaggagccctggtacacttgtccatcccggtccaccagaaacccgtgtcctggagaagggaccgagagacagacttggctttgtgcctcctcctgcatctgagaagggatctgccctccgctccttggagggcgggcaggagcaaagtagcaagtctaggaggcatggggctcagggccccccaggaacatgacagaccctccagacctggctacacagaggcctcagcacggctcggtgaggctctgaacgggaagggcagatgtgctttgggacaggtcggtgagctgacagggcagcaaaaatggccctggggtccagttctgaaaggtgcggttgaggggccctgcggactgccatctgaggctgcacaggctctgcgtgctgctggggtgaggatgggtgcagtttgggcctgtcgtttgttttcacaagaaacttcaagttcacagtgaggagggcagggcttgacctgaacgaggagaaactcaaaagaggatgggggttcgtaaactgcggcattttcagattttggacaactcagaaatttgagagtatttctgcttcttttgttttttttgttgtcgttgctttgcttttgagacggagtcccgctctgtcaccaggctggagtgcagtggcacgatctcggctcactacaacctctgcctcctgggttcaagtgattctcttgcctcagcctcctgagtagctgggattacaggtgtgtgccaccatgcccagccatttttgtatttttagtagagtcggagtttcaccattttgccaaggctggtctcaaactcctcatctcaggtgatccgcctgccttggcctcccaaagtgctgggattacaagcgtgagctaccacgcctggcctctgcttcttaacataaggaaaacactggaaaaagaagctccgtctgtggtggagggtattatgtgcttgactcctgtctcgggtgcgggtggccttttggctgtgggactacggcccgtgctgggcctggcttggctgggtagagggacagggcacagccccctcctggcttgagtctggcctcctgacttgcttgggccaacagaatgtggaggaagtggctaagctgtccaagactactgggcaaggagctgggcttcccaggcctatgaggacctcagggaccctcaggcctggcagagttgctgtgactatagccatttagtgaccccacatagaccagaccagaagcccctccctgcagggcccaggccaacctactgaccccaggatcaggagcagttaataaagcagtggccattttaacccctaagccacgggcgtctgttccgcggtagcggatgacagagctgcatcaagcgccgcaggacccgctgggcatactggtgtatgccgggcataggacatggcctggtggtgcggagaagagggcatgggccccctacctcctttccaaccctctgaagtcaggcaggccctctcagaggttcctgaacccaagtggacgtaggattccatgtcctgaaagcgcccaccctcacagcacccggctcctgtgggcgccagaccttcccgcatgccgtgggagacctccccttcataacatccgccggctttgtactccatgacgccgtagccttgaggctctcccagaacaaactgtccagagaaggtgtctcctgcatgtggacaaggaggaggggagacaggaggttcagttcagggctgcggccccagtcggctctcctctgtccctggcccatgacacgcaggaaccattccagaatggacgtccctgcctccatcatactactcagtctgcttcatgagggaaaacatggtaagcaggtctggtctccccaacagctgggcatgcagacagccccaggcagacactctctttgggcatctatcccgagggcaaaggaccctctggtcggtttgcagggtgaagggtgaggtttttccctggctctttaaaaactgaaagccaagcctgagagaaaacacctccactgagaacccaccgacccctctggcgtgagggtctgaggttcctggacacacagctcccggcaacgaatccccagagctggtttcccatctagggatacaatgtggctgaaatagctttaaataaaaaagaaatagtgtaacttgggacagataaatctttattctagaaaagtgtctccggaagcctgagttgctctcagcggtgaccacagagcctcagtcaggtccccagggcttctcggtaggccaggcctctcacggcacaaagcttcccgtctacacgtcacgccttctgcatctagactcggcggaccaactgagcccgatgggttatgagaaaggagtgaatgtgccatcccagctagagctcacctgaccaggcccagtgccggcggccttctcccgtgatctctccgtccacaaacgccccttcgtaataactgccatctttaaataacaacttcccgtgacctggcaggagaaatcgtcacgtgaactcagacagtggttgggttgactgcgaatgacactgtgcagtgttgggcctgtttctcagaaccaagagcttggcttcaaaacttgtgtttggctccatcactcatgctatacatgtatttaaaaataaaaaaatgttctcaaaaat

SEQ ID NO: 394 - DNA, 2652 bp, Homo sapiens
gcagccgcgcccccagccgtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgaggggggctagagacctcgcgacttttacccccccgaccccgatctccgactcctgactttggaagcccccaaagctgcttttcggttgcctacaaagtgtcggtcattgtgccacgtccttggaaccgtggactcattttctcctcaataacctttaaaaagtagctgtaaaacctccattttacagaccagttggctgaggtttaaatggaggacgctcccagggccccagaggggcgaattccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctgggtaagtggtgctggtcatgagcactttgggggacccttcaaattcccttctgggggaccccagcggagggcatggtcatgaattccgagaactgtatggcaaagccgggtgcagaggagagcctggctaagttctttcattctcctgagcttgactttctgtaatgtagggaaactgcgaaagctctgtaagtggggagatcttgcacgtttttcttgcttttgaacccatgatgtctggctacttgtagatactcaatatttgtgggatgaatgaacaatttaagccttttttttttttaaccagaaattggtcttctgtgactttcttgatgggggcagatgagatctttgtactgcattaagtggatagcgctcaggtcctttgggcttggcgctttggcaatctccaggcagctcactttggcctctgttcctggatcccctttgctcttttctgcgcctgcattcgtaagtgatcacgggctgcccgtgtcctggtcattggtagtgcaggcagaggaaatgcgggaaaggttgctgtgtttggagggtccacatcttcaccctcctgtcccaggagctttcctacactcctccttctcaaagctgcacacacctggggcctccaggggattgggggctgccgtgtgtgttatatcatgattagagctttcacttcctgctccctgctgttgggaaccaggctgtgtgtgttgcttaaattccccttgatgaccagcagagtcactgccactcagccatggcacactgctgtaaacctggttttgatctcctttcaatcttttgctgattaactacacattgatcagtgttggccaccctcaccctgccatagaccatccgctgtcttcctctgtagagttaactattttctcttttatgaggaaatagtgtgtttgcttaggagtgtttactgtctggtaactactgtgctaagccctttcctgttgcctgccatccctgctgcgagcagggacaagctgggtgctcactcatggcatcttatctgttgcagatagtccactgtgtgcagaggcatgggagctgtcatgttgggaacatgctagacctcagtatccttgagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatg

SEQ ID NO: 395 - DNA, 2294 bp, Homo sapiens
atcatgcactgcagcgtctgtgttgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagc

SEQ ID NO: 396 - DNA, 3242 bp, Homo sapiens
ggaaactcgaagatgaatgttttgagttgaagaaagaaatcgatgacctggaaacaatgttggtgaagtcagagaaggagaagcgtactacagagcacaaggtcaagaacttgactgaggaagtagagtttctaaatgaggatatcagcaaacttaacagagcagccaaggttgtgcaggaggcccatcagcagaccctggatgacctgcacatggaggaggagaagctcagcagcctgagcaaagcaaatctgaagctggaacagcaagttgatgagcttgagggtgcccttgagcaggagagaaaagcgagaatgaactgtgaaagggaactgcacaaactggagggcaatttaaagctgaatcgggaaagtatggagaacctggaaagcagccagcgacacctggcagaagagctgaggaaaaaagaattagaattgagtcagatgaattcaaaagtggagaatgagaaaggcctggtagctcagcttcagaagacggttaaagagcttcagactcaaataaaggatttgaaagagaaactagaagctgaaaggaccactcgagccaagatggaaagggagagagctgacctcacccaagacctggctgacttgaatgagaggctggaggaggtaggaggatccagtttggctcagctggaaataactaagaaacaggaaaccaaattccagaagcttcaccgagacatggaagaggccactctgcactttgagacaacttctgcatctttgaagaagagacatgcagacagcctggctgagctcgagggccaggtagaaaatctacagcaggtcaagcagaaactggaaaaagacaagagtgacttgcagctagaagtagatgacctcctgacccgtgttgagcagatgacaagagctaaggcaaatgctgagaaactctgtactctatatgaagagcgcttgcatgaagcaactgcaaagctagataaggtgactcagttggcaaatgacctggcagcacaaaagacaaagctgtggagtgagagtggcgagttcctacggaggcttgaagagaaggaggctctgataaaccaactttccagggaaaagagcaacttcactcggcagattgaagacctgagagggcagctggaaaaggagaccaaatcccagagtgccctggcccatgccctgcagaaggctcagcgtgactgtgaccttctacgagagcagtatgaggaagaacaagaggtcaaggctgagctgcaccggaccttatccaaagtcaatgctgaaatggtgcaatggagaatgaagtatgaaaacaatgtcatccagagaacagaagacttggaggatgccaagaaggaactggcaattagattgcaggaggcagccgaagccatgggggtggccaatgccagaaatgcctccttggagagagccaggcaccagctgcagctggagctcggggacgccctgtctgacctcgggaaggtccgctctgcagcagccaggctggaccagaagcagctgcagtctggcaaggcccttgccgactggaagcagaagcacgaggagtcccaggcgttgctggatgcctctcagaaggaagttcaggctctcagtacagagctcctcaagctcaagaacacctatgaggagagcatcgtgggccaggagacactcaggagggagaacaagaacctccaagaagagatttctaatctgacaaaccaggttagagaagggaccaagaacttaactggaatggaaaaggtcaagaaactaattgaagaagagaagacagaagtccaggtgacactggaagaaacagagggagccctggaacgtaatgaaagcaagattcttcatttccagcttgaactcttggaagctaaagcagaacttgaaagaaagctttcagagaaagatgaagaaatagaaaattttaggaggaagcagcagtgtaccattgactccctgcagtctagtctggattctgaagctaagagcagaattgaggttacccggctgaagaagaagatggaagaggacctcaatgagatggaactccagcttagctgtgccaaccggcaggtgtcagaagcaaccaaatccctgggccagcttcagattcaaatcaaggaccttcaaatgcagctggatgacagcacacaactgaacagtgatctgaaggagcaggtggctgtggctgagcggcgcaactctcttcttcagtctgaactagaggatctaaggtccctgcaagagcagacagagcgtggccgcaggctgtcagaagaagagctcctggaagcaacagaaagaatcaatcttttctatacccagaacacaagcctcctcagccagaagaagaaactggaggctgatgttgcccggatgcagaaagaagctgaagaggtggtgcaggagtgtcaaaatgcagaagagaaggccaagaaggcagccattgaggcagcaaacttgtcagaagaactgaagaagaagcaagacaccattgcccacttggaaaggacaagagaaaatatggagcagacaattacagacttacagaaaaggctggctgaagctgaacagatggccctgatggggagtagaaagcaaatccagaaactagaatccagggctcgtgaactggaaggtgaactggagggtgaaatccgtcgcagtgcagaggcccagaggggagcccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttt

SEQ ID NO: 397 - DNA, 2603 bp, Homo sapiens
gtataacaaaagttagtaatttagaaaggaggaacatgaagtaatatttttattccactttttcttctgcctttgtttttatgaagaactctggtttgtagatacaacgataggccaagagctgaggaagaactccatatgctatgtttaatgctaaaaaaaggatttttgcttcttcagggactctgtagacataagcagttctagcatgaagagatgcaccaatgtgagaaaactgagcctgttgcatttaaaaaaaaaaaattgagtaagcatgaaacgtgttcagttggatgcatgatgagttctgaatggttcattcaggctacgtttctgtgccctcaaaaccagtctcacctgcaggcaaaataccttcaaacaatccagagtctttaatgtcagagtctttcattaaatttagtccttgattaaatttagggccattcttgatatgactgttcaaataaagtagatattatttagtgtagttttatcatgccagttgtgttttttaaccatcaagtgccccttaccgaacattagtggctcaatctaatagaaaaatctgaataaaatctcaaatttttttctgatttgcgttctggagatcctacatacagactcagttgtggttcacaaattgtgttccaataaaaatgaagaaagcgcagagttttaaaaaacaaatatttttagcataaactattgaaagggaagcactggggggacctcagcttcatttatcagtctttcatctactccttgcagcaagagctcataccctttccctatgtgttttttgtttattcatttattcatgtatttgttttttctgcagcttttaagatattaagggttgtttgtaagataaggttgttaccaacttgggtggaggtaggagtacggttgctctttgtaaaatggcaaatgtacatgcaggcaacctttttaaatcaaattataatttatttagaagtacgacatgtcagcattatccgcatttgcaaaatggcctccctctctacttatatacttattcagaaaacacattcagaatgtgccaattggtcttttttgatatttttcgcaagcacagaggaaaaccgtattggaaagggtaaaacagaccacagcaggattaaaagctcctgtcagaaaatttcctcagaaggcttgtatcattacaaaatgtacccctggagtctgcattttcatatcttgctgaaattcaagatacacatgaataaaggattgggaatctaaatgtaataagtagtaaattatcagttcatcaggatcaaagagacaaaagactgcactatagagaaggcatagaagtaacaagaatgaagaactagataatttgctttaaatacatataagttattctacatttcttccatatgaaaccaatttattctgctgagtgatttcacagataaaggtgttacttacttgacttcaccatgacaagaaaaggacaagttttttttaagcagcatctttatgaattttttatcagtggcagatattttaatgggctgcatttttacaaattcctgatatattctggagacctgtggtacatttttgctactctggagatataaattaaattagcatgatgtattgccaaggaccagcacgtggattgtctacattgtgatccatgaggcactgagaggactcggccctcagatacaactcccctgggtagatgcccaggcagaacccagcaaatgtatatgcatctctgggctctgaggacaaaatgccttgagagtaaagggcactttcagggctgccctgaggaggtgctttctggacattctaggaactctgagcaggagcatggctcccatactgtttttccttagggcctgttttgaataatagtgtttttctgaatatataaccaagcattttctttggactggaagccacatttgatccctggttctcagaaatctgggtttggtggttctgtctttatagatacttgtacacatcacaaaatcaccaaatttggggaaatgccaaccatactttgagagaataaatatgagcagttgtgcctacttgcataggggagcctgtgtaaaaagtcagtgattccgtaggctcttttcctgcactaaccagtgcagttaatacctcactttcatgaacagcaaactcatggcaacattaagtgaatcatggccgggcgcagtggctcacgcctgtaatcccagtactttgggaggccaaggcgggtggatcacctgaggtcaggagttcaagacgagcctggccaacatggtgaagccccatctctactaaaaaatacaaaaaattagccgggcgtggtggcagacgcctgtagtctcagctgctcgggaggctgaggcaggagaattgcttgaacccggggagtggaggttgcagtgagccaagattgtgccactgcactccagcctgggtgacagagtgagactctgtctttaaaaaaaaaaaaagattcatgtccttagattagattgtaagcccactgggcaggtactgtgtctaatgttttgtgtggcacctgtcacattgttagagctcaataaacgttccccccc

SEQ ID NO: 398 - DNA, 2169 bp, Homo sapiens
gctttttgcttttcatcacctgcaagatgtacataaaaatcacataagctggaattcaacaaaagacctctgactatgtgaagatacggtgggaagatgactgaccgcaagacaggaagagagccctcaccgaggaaccaaattggccagtatcttgattttggatttctcaacctcaagaaccatgagaaatgaatgtctgctgttcaagccacccagtcaatgaaaaagtttggaaaccttcatctagaaagtggtctagcaaagtgtggtccatggatgagtttgatctgcaaactgcttgttattggttcatgacaaggtgtcagaaggaggctggcaaatttggcactcacagagggaaacctatgtgcttcgtgaggtcattgcttagagtacaactgctaccaagaacattccctgcaaactcttttgtgatcagtttcttcccttctctcatataccctctgcaggtctaccaattgcattttgagagctcagataagcagagagcaatgcaatttgtcacagaaggatgattatgtatatgcactgtcatgtctatttccatgcctaactcaaaggagacacaaggagaaagtgagctcagcctggatagattggagattgtgatgacttctaggaagcctcaggaaagagaaacaaagacaacactggcctgctgctctctgcaatggtgggacccttgtgggataactgttttaggaatgaaggtgtctaccctctctagaaatgaaaatgcaagtttggctgtggttaagtattggatggaggcaaaaagaaactgacatattttcttcttttcaattgtttgattcaccctgaagggcatggctgcttaatttttttctccagagataggtggacagataaagacaggaaagtaacatccacagactgccctctgtgaaggtgacagtgatgaaaggaatgcttgatctgaacactggtaaataaagtgaccgcatatttccctagccaggagagcaatctggctcaaaagaaacgagaacaatgacattactgccaggctgctcctaagcctttggctattctgttcagtgcacaaaaaaaagcagtgaacatagctgtgacctgccttgttggtagtatcacaattctttggggctccactttaagaaattgagacctacctaccttaatccttggggggttaagctttcagactggaatgataactgaactattcatttgcagtaattctgggttttgtgcatattttaaaaaggaataccgggcttgcctatattcattacaacgtcctcccagctttcaaatcttccaatacaatgcctcttctctagtcttttaagcacatcctgtgactggatatgattatgggagatttacatgcatccttgtctattgtatcaaaagatcagggaataaaatgcccatcattaaaaccccaaagtgattggattggcatgaggaatggggatggggctggcatggaagagagggttctgactctgagatttcatgaaatgcaaaacaataggacagctgctcttccataaacagattattattattatttctacctagacagcttgatagcagccattatcttctttctgggtgtcttatcaagttccggctgtgtgcagcatgggtgataaggaaagagaaatgtcacccatgggattgccaaggattatttctatgcactgctgttcagcaacagccaatctctcagaactgagaagaagtcctattgttcacgctgggcagttgctattctgactatcccaagagagcagaaaagggatgtagttgccattgtgcaaaagattgatatttcattactctcagctaaagttctgaaaagcagaatcatcatgaaatatctttgaagagagaaaagacaagggaagaaaagaagaatgaaatgagttcagagctttttagaactgtgagggagtgcgaaaaaagaaaggtgtaatactttcaaacagtggaagttaaaatgccaggcgtgtaagcctcagtgaaattgagcagcatcacgtcaccacgacttgtggtccagctgtttattgcaaagactccatcctgcgttactcatcagaaaatagttaactttgtatctggcattattttaattaaaaaaaaagttaacttact

SEQ ID NO: 399 - DNA, 1822 bp, Homo sapiens
acaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcgacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggtgagtcaggacaggacggagacaccgtgcatcctcaatgaagggagaagcttgagcgtgttaaggtccaaatgtaagagaaatttagaaattcctggaaagtcactgtaactatttcgctcatttaaaaactcaaaaaactggacttaaataaaacctgataatatatg

SEQ ID NO: 400 - DNA, 2208 bp, Homo sapiens
ctttggtaaccctgctagggggcgccgctagattccatcctatttctccgatgaaagtatcagaactctcatcacctgcaaatctgggggaaatgcaggtgcgcacagagagcgttttgggcaaagacggcctttaagcttttcttcactaagcatgccgctcgctagcggaacagcagccagctctggacgggaccttgcacagttccgatgacatcacttccgggcgccaggttcgggctttctcctgcagcgataagggcagacgacagtctttagtagggaaaggagacaagtgctagctactgccgcccaagtggaaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagacttcctttaataaaacatccagagtgctccaccatgagtggtgggaaagccatagaacatttggccaaacaaggaaatagatttcattttgacatcaaacctcccttgcatcatgctaaaaattgtgattttccttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctgtatccgcagagctctggaaattttaacaaacgcaacacagtgcactttgttgtgtcctcctcccagactatgcactgataatggcattatgattgcatgatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagaaatcctcctgccttagcctcttgaatagccgggactacaggtgtgcatgtccatgcccagccaactttatttctattttttgtagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaacttccattcaaaaagattattcagttatgttatttgcatattaccattgttaaaaataaaaaaattttt

SEQ ID NO: 401 - DNA, 2159 bp, Homo sapiens
gctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcaacagaggctgaaccaggtgggtgatgggcacccagcagggaccacgcatcctccagggctgtcctccagggaggagctctgctgtggccacagctagtaagagggaagaggatcagcagacagagcactggactaagagtccactcctggcctgagtcctccctctgccattcactttgctaggtccttagggcgagtggcttccctgaacctcagcttcctcactggcccagtgtactgcatgctgattctgatttcattcttataactgtcttgtgagccaggtggcattcccattttagagatggggaagctgaggcccagagggggtgagtgatttgaaccaggctgcacaaggagaactcagtctcatgctctgtgccccagctaccaggctgatagcaaaactcatccccaggttggttctgtttccccactgagtgggcccttggtccaaactccacaggttttcagagtaggaatccccctagctccacccacttcactctctgcttctccctccttcagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctatggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccatccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagcc

SEQ ID NO: 402 - DNA, 3494 bp, Homo sapiens
attttccagtgagagaccgcggagtgttgggtcgtgtagaagtgactgaacccagaaggtggagacgagacgttgtcccgactgcacagaggctgctctgcagctccttaaaggcgctaggcgtgacccgcaccaaggccgggatcgggaccaccgtgcccgggtacctgcactgctcgccccctcctttcgaccccgctttccccacccagtcggatggcggcggccgcgctgaggcccccggctcagggcactgtgacctttgaagatgtggctgtgaacttttcccaggaggaatggagtctccttagtgaggctcagagatgcctttatcatgacgtgatgctggagaacctgacacttatatcttctctagggaaatgatgtcactctgaaactcaggctggaatacactggcatggtcatacctcactgcggcctcaaactcctgggctcaagtgatcctcctgcctcagcctcccgagtacctgagattagcccagagcagtgtgacctttgaagacgtggctgtaaacttttccctggaggaatggagtcttcttaatgaggctcagggatgcctgtaccatgatgtgatgctggagaccttgacacttatatcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgcgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactgaggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcagtcctcctgcctcagcctcctgagtagctgggattatgagtacacaccaccacgcccagctaatttttgtgtttttagtggagatggggttttaccgtgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgggacggagtctcactctgtcacccaggcgggagttaggtggcatgatttcggctcactgcaacctctgcctcccgagttcaactgattcttctgcctcggcctcccgagtagcagggattaccggtgtgcaccaccatgcctggataacttttttttttatttctattagcaatggggtttcaccatgctggccaggcttgttatgaactgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatggccagacctcctctctac

SEQ ID NO: 403 - DNA, 2299 bp, Homo sapiens
tgtggtctgctcaggctgctataacaaaataccatagaccaggtagcttgtaagcaacaggtttatttttcacagttctggagactgggaagtccaagatcaaggcaccgtgaccctggtgaggacccacttccagggtcatgtcctcacgtggcagaaggagtgaaagctccttttgtaagagcactgatcccattcgtgagggctccgttctcatgacttcatcacctcgcaaaggccctcccttcaaataccaccatgttgggatttggtttcaacatgtgaacttaaggggacacacacattcagtccaaagccacaggttttcagcaggagagcagcatgtccagatgtgtgttgtacacagactattttgactctgtggatctgagacagttggggatgaggcagaaatctcccacactcgagcaatgataaaggtcaaggtggcagtgaagcggggagtgtgaagaggtggtaaaacttgcagcactaattgcagcactaagatagaggcgagtcacgcaggcgcaggcgaggcacagcaagaggcgaagaagagtcccggggctgggttatgtgacaaagggatgactgggggaccatttgttaagataaggaaccctggagatagtaataaattggagaaggggctcttggcccctcttggatgatcctgaagttgttggggcaggaccaaaggcaagatccatgccaacgctgctgaccaacccccaaaaccaagctggctttgggtctgtgtctggtgccactgggcaatgtggcctagatggaagggtgaaggggtcccactctcagtgttcttcctgtgttcttcctccttccatctcatctctatctctgggctggtttgtgagctgaaagagttcacacatacctggggtgggcctctgtctcctcgacagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtagtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 404 - DNA, 2861 bp, Homo sapiens
agttcacaacagggctcgcgctcctatgagaatctgtgccaccgaggatctgacgggaggcggagttcaggcggtgatgctcactcgcccctcccctcacctcctgctctgggatccagatcctgacaggccagggaccagtacctatccatggcctgggggttggtgacccctgctctaggggatcctttcttgcctcttgcgtcttctggggactccaggtgttccttggcttgtggctgcatcactccatcctttgcttccttcttcccgcagtttcctccctttctccacgtgtcctcctccctttctccacgtgtcctcctggccctcgtaagagatgtcattggatgcagggcccaccccacattcagagtcatctcaccttcagattctttacttaattacatctgcaaagacgttttatccttttctcttttcttcttcttcttttttttagagacagggtctggctctgtcacccaggctggagtgcagagccgcaatctcggctcactgcagccttgatgtcccaggttcaggtgatcctcccacctgagcacccacaagtagctgggactgcaggtgcacacaccaccacacccagctagtttgttattttttgtagagacaaggtcttgccatgttgcccaggctggccttaaacccctgggctcaagcagtcctcccacctcggcctcccaaagtgctgggattacaagtgtgagccactatgcccagcctacactctttttccaaataaagtcacatccccaggaactgggccttcagacatgagcgctccttggtgagccaccgttcacccgttacggtcctccagaccaaatgcctggttcttcgttgctgttttccaaatgctacctccttactggctgactagcaatggggagtaaagcccacctctgctcctgcctctctgggaaagtattgcctccttggtctctggttcccatctccaaaagaagctttaggctctccccccgctgtgacttgctgtcatcatggaacagatttttgttgtgcacaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtaaatccagcagaaatgtttctctctccatgtttcatgtctgtagaagaaacgtgaggttatttccatgaaggattgaaaaactttcttatatacacagtaacttttttactgtcctcctttctgcaaagggacaagtatgtttaaagcgttttttaaatttacttttttcgtgttgacaaataaaaattctatatattgatggtgtccaacatgacatttcgatatgtgtgtcacagtggaatggctaagtcaagctatttcacatgtgcgtgccttaccccacacgcctattatttgtgtgtggtaagagcacttaaaatctactctcttagcaattttcctatattaactacagtcaccatgtcatgcactggagctgttgaacttacttcttttgtggcctttgaccaacaatctccccacccaccagcccctggtagccaccatcgcactctctgcttccacaagatcaccttttcaagattccacagatgaatcagaccatgcggtatttgtctttctctgcctggcttatttccctttaagatgttcatgtaggttcatccgtattgttgcaaatggcagaatttccttctttcctaaggctgcatagttctccactgtgtgtgcaccgcactttctctatccactcatccatcggtgcgcgctcaggctgattccacagctgtgctgttgggaatggcgctgtggtgaacgcgggcgtgcagatgtctcgtcggcagatgagttcatttcctgtcagttatacccggtaatggggtggctggatcgcagggtagttctatttttaatctttggaggaatctctgcactgccttccacaatggctacactaattgctgagtgtgtttagagtctggcatgcactccttttggctaggctctatttgctggcattacataaactaaaattagcagctggacacccctctatgagtatggtgacaatcactgtcgtttctaagtagccagggtatccagatggcgtcatggcttccaacccaccctgctttccttttctttttctaattaattattaatagaatcaagaaaggacaatacaatcaatgaaaaaggacaggcccttcccttttccaaagccagtttgggagccatgacagagcagcttggccatggcctccctagcgcaggggatcatctgacgagaggagagagccggccagtgagtcactgtcaacaatgataaatcagaggccggctgcaatggctcacgcctgccatcccagcacttttgagaggatcacctgaccccaggagttggagaccagcctgggcagcatggcaaaaccccatctctacaaaaaatacaacaattagccaaacgtggtggtgcacacctgtggttccagctacttgggaggctgaggagggagaatcacctgagccaaggagatggaggctgcagtgagctgtgatcgtgccactgcactccagcctaggtgacagagccagagcctgtcgc

SEQ ID NO: 405 - DNA, 2551 bp, Homo sapiens
ttctgtgtgtgtgtgtgtgtgtgtgtggttgtgcacgtatacctgagtctctgtatgtgtgcatgtatgcctgtggtatgtgtggggtcatctaggaatatttctggccagggaagggtcctggcaggctaagcctctccttctttccttcagccccaccacaaaaaaagataccctccagcgtcatgggggttctcctgggctccgtgcaggagccatgcccactctcctgtgctctcccctccaccctttgtgctttggtcacaaagcattttgtgccacatcttccaactgagtctccccctcgtcctgcttcccacgtccaccatgcccagctgggccttcctcacctccgcataatgtactgctctgccctggcctctcctgctcattcttcttgacagaacaaccagggtaagcttgtatactggactctggcctcagtgctgacttggtgaggtacaagataccctcattgtcgttcatgcaagaaaatcaagggttgcgggttctataaatgtaacaagcatagttcaggggcctgcgatccggcgcttccaacaagctcctgggtgatgcccttgtggatgctttgtggacagcagcctgacactcatggcttcctagggccatatgcttcagtcagagatgggcaaactgaggcccagaggggcagggagttacctgaggttacattacgagagggaagggagaaggggactcccacccctgccctgccctctctcccaggattccaaactcatacgctctagggattgaaaagcagaaatgcaaggatacggtcaggcagctcctactcagctcctgccactgtccccaggaccatgcaggcctagtgacagcagtgcacctgattctcaagagaagttggaaatgcagaatgtcacatacctcccagttttagatcttttctggtcaaaccaaacctattggcaagtcaagtggctctggagtgcccatctgaacgctgctgttttccatcccaggagtgccagcaaggacacctccctctccctcagcctctcgcccatgccctccctgaatggcctcactcgctgcatgtggcaggtatctggccttcctgcacctgaatgctggggctggaccaggtcaccccagccctgttcaggagagaggcccgaggcccgagaggcagaatggaggaggcaggtttaagggtctggcaaacgtggctgccagcgctagctctgcatgctcttaactgtgaccttcctcagcctcagctcccttacatgagaagtgacgatggtcatgacagaccccgcagaacctttgtgcacgtgatccaagatcagaggcaagtccctgatgcaaggcagtagctctgccaactggggctcctctctgggtccctgctctttctgatcaattatcggcacaccctgcccactgccaggggcttttaggtgctgtagacactgcccatggtccacttcgtactaaaatccctttaccctgcctgggtctcctccctcactctcctcctgatttcccattccattttcacccaagctccagctcttcctggagatgcctccctccagagcaacagcttctcaacaggcaatgtagggatggaagagtcttcatcttaaacacaagctctgctggccaggtgcggtggctcatgcctataatcccagcaccttgggaggccgaggcgggtggatcacctgaggtcaggagtttgataccagcctggccaacatggtgaaaccccatctctactagaaatacaaaacaattagctgggtgtggtggcacacacctgtaatcccagctactctggagactggggcaggagaattgcttgaacccaggaggcggaggttgcagtgagccgagatcatgccattgcactccagcctaggcaacaagagctagactctgtctcaaaaacacacacacacacacacacacacacacacacacacacacacaagcactgctatactggacgtggctgcctggggcagtgtggaatgagatggtctgacgtcctcactcagtaagaggaacggctgggatcagttagtgatgtctgctgtgggtgcggtggtgaggagtggcaatggcacatgtgcagtgtgcaggctactcaccatcccttgcagggagcacctgtcatccaggcagctcttcccaatctgccttcttattcacactcctcgaagccccaccgtgagcttggaggcagtgcaccacataaaacataagaacatcgggccgggctcggtgactcacgtctgtaatcccagcactttgggaggctgaggcgggtggatcacaaggtcaggagatcgaaaccatcctggctaacacggtgaaacctgtctctactaaaaataccagaaaaacaaattagccaggtgtggtggcgggcgcctgtagtcccggctactcgggaggctgaggcaagagaatggtgtgaacccgggcggtggagcttgcagtgagccgagatcgtgtcactgcactccagcctgggcgacagagtgagactccatct

SEQ ID NO: 406 - DNA, 2185 bp, Homo sapiens
ctcacaactcagaatctgatatcttaaatcactgattctgttacatgctaggaacaaaatgccaacatctcatgtaaagaagttgcataatcatgaaaaataaaggatgtttcctatgccagttagagtggtttgacccttcaggtaaaaagatatgttactgttatttttctacgtgacagaacagactgaattaagctagggaggcagtgatgttggcttttgggaaagggttcaaaaaactgtatggcaacattaatgctaaaatgttaagccgagtgcagtggtgcaaggctatagtccctagtagctgggactacatgcacacaccaccatgtctggctaacttctgtatttttttcttttgtatagatggagtcttgctatccatctatggagacagcctagttgcccaggctggttttgaactcctggcctcaagtgattctcctgcctcaccctcccaaagtgctgggattactggcatgagccactgcaccagcctcttaaagcgcctttaatcaataggttccctgcctcttttcttgtttatcccccctacctcttttttatttgtggaggagactagtcatttgttccccggagcttcccacatgctggattttgctgactgccttcctgtggcaatctgcgtcttcatccccagaatttccaggacacttgtagttaggtctagaagctggacttgattcaggcttaatattttttagtaagtatacttgatagcaggtggtgtacacatccatcaggaggcacacaatgttcagttgtctctcttttatgacacaaacagtcactgatgatcattaactggatctattctttcaataacggtttgtaaaatggtaaaattctaccattccctcttcatctataagctggtatattgattaccttttactctgacctctggctctgcctcccaggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatggtaagcagcatcggtctccactgtcaccctcaggagaaggtaaaggagaattctagttcatgagcctgagtttacagtcaccgcctgtccccaggagaatatcggtattttcagaactgccaaatctaagactttgggttcatttttgacctgaccagaatgtattttctggattcagacaggtagtagacaccctcaaacagccataaattctaaaatctttgccattgtcatgagataataaaaaagaggcaggaggagtcaccaggtgtcagtggatcttgtttctggctcccatgtctttgacagtaagactggtgacccagcagtggttatatgcactgactcaggagacagagggcctgggttctaatcctggctctgcctcttaatgacagtgtgactatacactattttggtctcatgtgcctacttgtaaactaaggatgatatattcttaggctcatggagctgttaggattaaatatgataatatgtgtcaccatacttaacgcagtacctgcccagtatgccacatcagctcaacgctgatgaaaacgatggtgatgtaattgctctgtgtctgtttcctcctcatctataaaagaggtgtaatatttctattagaatgaaatgaagcagtactttaaagtcactttgatgcccatccactgtagactggataaagaaaagtggtacatatacaccatggaataccatgcagccataaaaaagaacaagatcatatcttttgcaggaacatggatggaaccagaggtcattatccaaagcaaactaacacaggagtggaaaaccaaataccacatgttctcaattttaagtgagagctaaatactgagaacacatggacagaaaaaggggaacaacagacacggagtgtacttgagacagaggagggtggaaggagggagaagttcagggaagaaaaactgctaggtaccatgcttactacccaggtgacaaaataatctgtacactaaacccctgagtcacgagtttacctatgtaacaaacctgcacatgtgcccctgaacctaaaataaaagttgattt

SEQ ID NO: 407 - DNA, 2181 bp, Homo sapiens
atttgaaaagctccccagtgattctaatgggcagctgggggagaaccatgggaatacagtcacatagtctctttccactcccccattccctgtgctatttaagttctaaaatgctattgagggtttcttctgtgctagactcatatttatttatgctcctagctaggaaagaaatgtgtcctcagagtctacaggaggaaacttctcgtctctggagaatttttgaccatgagttggctttgtaactctaccctcagagggccttttaaacagctggtggttcttaaagaaatgaaatgcatgatgtgttactgctttgagctccgctgtggcagagcctggagctgagctcttggtgactggtcactgcacaattccatgaaagttcagataatataattgggtggtaaatgacacactaaatgaatctcttgggtgcagttgtttgcatcctaaactccagaatatgcagaaagagatattctgtgatagatatatctgccagttgggtaagcaaacaaaagtagatttgtcttcggcatgtgcaccaatggcaaactgcattcctacctagctttgaaataaattattggaagttctctggtgccttaaggtggtgtagaaggaaaagatccctggggtttgttaatgtatttagtcctcttctctgtgttatgggaatttctaaaaacagataatttgtacgttggacctaaaactgctttcaagaactcagtagacttgggattgaaggattgggttttctctttcccatgtgaacttccctaaatcctactctggcttcagaaagcacagctcctatacaagtctgacttctgcatttttagtgtaaatgtaatgtattgagtaatggaaagactaatggaagaattgatagctcaaaaatgagttttttccaacaccatttttttttgtctctgaaaacaccagcaggctgtgtccaagcatgggctgatgatccctttatgtgatgatagaacaagggaggagagagacaaattaatgggattgttaaaaatggctgaaaacttgatactaactttgagtcagtattttctttttaaagtcgtgtaatacaatatttgtagataggacattgaaagtgatgggggaaataaatgtctatgcagtgacgttatagccattaattctttagtggaaaaggacaaggtctgtacctaacagcagtaggagagtgagttttggggccagacacgcgacggctctgctgccgactaactgtgcaagcttggacagggtacctacctctcttaacctcaaagtcctccatggaaatagcgggtaaggtgtgaagattaaagaaatagcacgcttcttaaagcactcagcatgtcagtggatgttgggagccttccctcacccctttgaaaatgggctctgcacaaacacattttggtgggaggctggggtctatcctaccaacctgagttgggggaataagatgatctcttccacagttcgggtttgcacaaccagcttttgcaggtgaggcagggaagaggcatgagtgtcattggcagagtgataagcgaggctggcaagttcactttggtagaacctctgtggactccttagttcttccaggttgaatcctgggcagaaatcacatgaaagctgtgaagcacagacatcagtttagaaattgtgtactttcccgctgaatcccaaatgcacaataactgtacaccttgcggttgcatgaatctacaaggtctcctatgcgccctcattcataaactcaaggctgagaatgttggcaggccaagtcctgcccctccccggagtgagctgccttggttcacacgggagtggtccagcgacaggacccgacacctcccctccggaagctcttcagcaggacctgcctcgggtcctggggcagctatcctccggggcctgcctgcagtgaaaccatcagtccgtggagatgttcactggattcctgaccagttgtgggtcgggctcaaccctccctctgggttttcaggatttgtaatgatcgctccatttgtgtaaaataggccggcattttctcttgttactgagatgtatttttctatgtgagttaaatgtataatttgtgtaattttgtacattaaaatgtatgctttttcacaattaaagggtttttttcccttc

SEQ ID NO: 408 - DNA, 2323 bp, Homo sapiens
tcaatgaatgtgtgacatttatattcaatcgatatgcaaaaaattacaggtcagcaggcataaaaaatttggctatggagttttggttacacgagtggcatcaacagcagcaggtggcattgcactaaaaaagtcagggtttattaatgaacttataactgaattatggtccaatctggaatatggaagagatgatgttagggtaacccatcctagaactactccagtggatcctattgaccgaagctgtcaaaagtcttttttagcactggtgaacttgttatcctatcctgctatttatgagcttgtaaggaatcaagatcttcctaataaaacagaatattctcttcgtgaagtcccaacatgtgttattgatattattgatagacttataattttgaattctgaagctaagattcgttctttattcaactatgaacaatcacatatctttggtctaaggttattaagtgtgatatgctgtgatctggacactcttctcctgttagaggctcagtatcaggtatctgaaatgttactaaatgctcaagaagaaaatatcttggagatttctgagagccacagggactttataattgatggcttatcagtggagagaaatcatgttcttgttagaataaatcttgttggtgggccattggaacggattttgcctccgaggttactcgaaaagagtgataatccatatccttggccaatgttttcatcatatccattgccaaactgctatctgtcagacattacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctagttaccttcctaatgacactgtagaatctggcatccatccagtatatttttgcagcacccattatattgaaatgctactgaaggctgagttgcctcttgtgttttcagcttttcacatgtctggttttgcaccatcacagatttgcctgcaatggataacccagtgtttttggaattacttagattggatagaaatctgccattatattgctacttgtgttttccttggtcctgattatcaagtgtatatctgtatagctgtattcaaacatttacagcaagacattctacagcacactcagactcaagatctgcaagttttcctaaaagaagaagcactgcatgggtttcgagtgagtgattattttgaatacatggaaattttggaacaaaactaccgaacagtgctgctgagagacatgcggaacattagactgcagagcacatagatcatgagacacacggtttaaatttaggttttatttatttttaaacacagcaggggggcttgatgtttttctgtgtctgtaacaacatttactttgtgaatatacatattgtaaatactgagaagtataacgatatatttaagtaggtatgagctcaatttgtgaattcatttttgtaaatttgttgttttgtaaggttattgtagaatcagatctagcttacttttagttcttattcatgtttaagagttagtcctggccaggcgcggtggctcatgcctgtaatcccagcactttgggagtctgaggtgggcggatcacgaggtcaagagatcgagaccatcctggccaaaatggtgaaacctcgtctctgctaacaatactgaaattagctgggtgcagtgatgcgcctgtagtccctgctacttgggaggctgaggcaggagaatcgcttgaacccgggaggcggaggttgcagtgagccaagattgtgccactgtactccagccaggccacagagtgagactctgtctc

SEQ ID NO: 409 - DNA, 1835 bp, Homo sapiens
accttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaatttttagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaagtggtttactttgtagagtttacatggttttatgcgcacactaattgtaataaactatgccaaacc

SEQ ID NO: 410 - DNA, 2016 bp, Homo sapiens
ttttggagttgaatattattccggtgcctccaccacccccagcagaaaaaataagatactgaaataagttgagtcatttcgcaaacatttactgagcacctcctgtgtgccaggctcctagaaagacagggagttggtgccctgcacagatgacaaactgccccagacagcagacagaaagacagacaaactgccccagacagcagacagacaaacaaactgccccggacagcagacagacaaacagacacattgccctggacagcagagagacaaacagacacactgccccggacagcagacagacagacacgttgccccagacagcagacagaaaaactgccccggacagcagacagacagacaaactgccccagacagcagacagacaaactgccccggaaagcagacagcaaactgccccagacagcagacagacagacacacttccccagacagcagatagacagacaccctgccccagacagcagacaagctgccctggacagcctgctcaccttgcctgccacagtgcatgccccacagggagaagccttccttctcacccagggagtccagccattttcacctcccctggtccatgctcaggaagtctggtcaccctggcaaactgcacctgacattgaggtcccttttcaccaaagatgcacaaggtgtccatgccgagccgacatcattcaggccaagggcagaggatgtaatgaggggtggagtgaggatgtggagagagagcagagagcgcctcctattctaccgcggctgcctctgcccccacagcacccacagatccctggcccttccaggagtaagtcctgggcaggcagagctggggttggcctgatcccacctgccttgctcttggaaaggacatcaggtgtgggcaaagcatccttgaagcccagacaacacaggcatggcctgcgtgccctcccagcatctgctgcgatggcctcaaggcctctccagtcccctgctgcaccatgccactcagagcccctgagtgagccccctggaattgtctgcaccccccaagccccaacaggaagaagggaaaggcggggaagctgacgctcactcagtgcccactgggtgccaggctctgggctcaaccctctaatatccacacattccatccccccagccccatgtagatggtggggttaagaccattcttcagatgtggaaatgaaggctctgggagaccacaggacatgcccaaggcaaagagttggtagcccctggatttgggaatcaaactcaagcccatctaatccaagggtaggaaatgtctctaaaacgttgatcaatctgaagcttacagattggaaactgggccaggtcagccctggcggtggagtccagagacagagagaaggctgcagggaggggagagaacaggaggatcccgggccagggtgacttcagtgacattccttccctccttcacaagcacgaaaaactcgttcggagaaaagacagcttctgccttccctaccaggcggacagggtactcactgtgccgacgtgagcagacacagccagaggctcaagtgcccttgccgagtgtccccactgctcttggggaggccccggcacagccctgcagagatgcaagtaagagagtgcccagtgccctcggcagatgggtggcagaaagcaggaggaggaagagggagctgaccgatgccgggtgtcttactccgctgagatcagaacccccaacatgccgagcagacgcaggccacattgctcggggaacaggacaccagggcgctgtgctagcggcccgcagacttcacttctggctcctgtgagggcactgtattgtccagacgcttggcaacgactctgcctgcaagtggcaaataccaacataaccacatcttccttttagttgccacaaatattcagttttgttttatccatcatgtcccccatatgcatgtaatgaaacatttgtgaaaatcactttaataataaacaggaaatgaacct

SEQ ID NO: 411 - DNA, 3165 bp, Homo sapiens
attcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtcagtttttactgcttcaggccctccaaacatactctgatgacatcttgtcttctgaaacacataccaaaattgatcccacttctggcccagggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttaatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctgtctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccac

SEQ ID NO: 412 - DNA, 2102 bp, Homo sapiens
aacaatgcaaaaaccgtaattacgtttgcaccaacctaatagttgtttctaaaaaaattttgctgggccaggcacagtggtgcatgcctgtagtcccagctacttgggaagctgaggatcacttgagcccaggagttctagtccagcctgggtaacatagagagaccccatctcttaaaaaatacttgttaggcagcacatttctgaaattcaagaaaggtcagcaaatttggaacatgtgcccttttgtaaacagaagagtagatgagttgattataaatgggacatctcttctgcatacattctacaagttaaccagagggctatgtggtataaaagatgtttgtggtcacagcctagctcaggctagagtgttgcagagaccatcccaaatcctccaggctgggctcaaggcttctctaaacccttctttgttgcaaaatcccatcttttcatgcttcattggtgacatgtggccatctgccacatagaacaagtgagagtactagttccatatctttattaaataaccatttttcttttgtacaaagaataaatagaaattctgatatttttcttctcatacttccgtcactcacccctctttggaaaccactgcataacagagctaaggggaggataaactaatgtgcctgaaattttactttagtcttcagcctataagagatcactatcttttttcccattttcacctagtttcacagcaaatttacctacggggggaaaggtattattattcttaacatgaaaccacaatatttataagaaagaaattgtgaactttaaagtgtaaagataagggaacactggaatggcaagcctgcctaaggtttttcactctttttgttttgttgtgtttttcttttttacccaacagtgggatctttctgtgcttgcacgagttctaacaataacacctactggtgtttgcgtacagttagtgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcaatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaac

SEQ ID NO: 413 - DNA, 3604 bp, Homo sapiens
caaagatgtcctcttggctcactgtatgaaaagagaggcaaatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctcc

SEQ ID NO: 414 - DNA, 3849 bp, Homo sapiens
tgatgaaaccaggaacacctgccttcttttgaactggagcttatgttaacactttctgctaggattcctgttgcctatgtatctcggcttcatttatccaaagcgatttttccaccttagaagagtccggacagcaaaccctgaactcagtgctcagtgcccaggtctgctctgctcagagtcaggctccgctcctccacctggatggagagggtggccatggtcatggtccaaggtggggttcctggaggaaggcaggcacatcaggacttctgatggggccgcgcacaacctaacaagacctctacagcccatcctcaccagttcccttttggcaagtggaaaaggggcatgcactattcgtgctgaaggctgggcaagctgcagacacaaaaattggttgcaatggaaacctgaagcagaggacataggtaccaagttctgctgtgccccgtggtgaggaagcagggggaggtggagccctctggagtaatttttccttgactggtgaggtgggtcctgaggatgaagggtacagggcaggccccagcaggcaggagattccaggtgtagtaaaaagtgctcccggatgtgagtggatggaaaagggcagatgagcaggtggcaaggtcaccacctctttctgggaatgggactggctgtcaagtttcagaggggatcttgcagggcggctgggtgggaggtgagccagatcctgtcaccaccagaaaggatctccttgagtgaagtgtgccaggcttgaaatgcgtcctgccatgccagcgggcatccctgcatcacccgtcaatcctgcaaacactcatcaggaaccggggtcatggtacggctgggaggcctcactggggtcacagtcatctctttctggtctgccatgcagagtatgaccagacacagataggccaggatccatgcaaccgggcacagcagaacatccggagtgccgtgaacatccggagtacgatgaccgccggtggagaccaggcagcactcacgcagtccgaggctggccaccagcatacgcaagctggtatctgagtcaggaactgcaatcattgtccttcgattcccagaacataagtccttgccggccccaaaggctggttattttgatgctataacataacgtgttcacatacttgttcatctgagacgatagcttacaaattcaatttttaggtacactgtggccctattagggccttcctaaacagaggttcaactgaatccaaatccagggcatcccatgaagatcctgaccaagaaaacactcacctccaccctcctccaagtggccatgccagaggccaccatgtgatggtaagtgtgttcagctgcccacaaagacatcaaacacatgggaattcctcacttggatgtgtcttcagtgcagacttcatcactctcaggattctggttcggttctaggctcccatgaggctcaacttccttggacatcctgctgccctaaactgtctgtttggggatattttggtcccagcagccttcagccatgttctctccaccctcagcaaaagaatttgagggcctgaagaaggaactattcactctttggcccagatggtgcccttaatgcctctactccaaaatattgcctcttggaccaatccccgggctccaggaacttcagcctcagggaaatggaagtcggtccctgtttctggcccagctttctatatgtgctccttggtctgggcccaaggtgttggactcctgtttgctgggagaggcattaaatacgcccaagggctttggcctgccattcccaaggcaagtatatgcatcttgcagagatgtgaggtccccagcaagaggtccacagcactcttgccatcctagctcctctgctttttcctttgaaaaggctcccaggtaaggcaggaaccctggcctcacatccaggctctgacccggaagcaatattggtggttcagagagcagttatttcctaaagactgtaggaagtgagtacatgaagaagagtttactagaccaaaaccttgagatccaatagtaaagtaacaaaaacccctcactctaatcaaccatataacaacaataacaacaacaaaaagtgttctaacattctgttactctgtacttttgcagtactttgggaccattgatagcatcataaacaggaaaaggactgtgtctcacccagagagaaagctctgttagataacacaaggcctctactcttgataacaagcccctgatcttcaagatgcttgtagactctaaatgaaatgatatcacaaatacggaaaaacattattatgttaaatttttttttaatccaccacataggacttatctatgaagatatacaagagatgcactggctcttacaagactcaagaatcgacttggccctattgagttgggctcggaatctcctttacattgatccaacaggaataaaatgtactatttggaaatgtctatcaagatttaaaatgaatctatcctacggtcagcaattctacttatagaaatacatccaacagatatctgcagcagctttgtttacagtagctaaaagattgcaaacaatcgatgtccatcagtagaaggctgtttaaataaattatgtgtctaatggacaagtgggataatatgtgtagctatcttcttgtatatgcatagaatatttctgaaagaagccattaccagtagtaacagctgatatgaataggggatagggaagggtgcctagcctaggggccaggaatgggagtttcttttcactttattccccttcacactctgaatacttaccatgttcattaattgcctactcacaaaataacttcttaagggaaaaaaatacaatctgtgcttgaaaggaacaagcccactgactgtttcgctgagtgtcaaagaacagaagctgtgagtatcaacaaggagtctctaacaggcagacacgagtcaagaaatatctacctcgttagcaggagcctctaaaaacacctgctgcctttctatcccaggagacatccacacatgagaactctttttcaatacggtctttaatatccagagcaatagatttaagcaaaagctaaaactgagtggagaggaagcagcaaatatcccaacattgacaccaaaaaaccctgcccctgctggtgatggtggagagggagggagggaggacgtgcctagaccccagagtccttttcaggtccaaatgttctcaaacctttctccgcaagctacagcatctcctgaattcttcccagaagagcgtctgacatgacctcgtggaactctgcaccacttcatcaaggactacatgtttttatttcacttgccacttccttaccttaaggtgggaagaaccctttggtcaactttctgctatttctgcagcccaggctctttgtctccaatcttcttggtagcccagtccctcccttgaatcacacctataccaatactatggctgctccaagacaactctggtctccttctgctggtggctagcatggtcctgtaagaatcccagagccaactcgatcttcctagcacagggtgattcagacatccctcaacacctgtatccaacaggtgatcacctgctgaaagagacacttccccgatgctgaaaactttactactacaagatgaaaggaacactgttcaaagagtttgaacattccatgaaatatgactcaggcctcaagcagagaagagtcctagaataggcaaggcccataaaatcaattacctcccagaagctccagaggagaggcatgatttggccacatacccttggaagacaggactggccatgattcacat

SEQ ID NO: 415 - DNA, 2289 bp, Homo sapiens
aaggctacggttcgcgccagcggccggcgctatggggctgagccgcgtgcgggcggttttctttgacttggacaacactctcatcgacacggccggggcgagcaggagaggcatgttggaggtgataaaactcttacaatcaaaataccattataaagaagaggctgaaatcatctgtgataaagttcaagttaaactcagcaaggaatgttttcatccttacaatacatgcattactgatttaaggacttcacattgggaagaagcaatccaggaaacaaaaggtggtgcagccaatagaaaattggctgaagaatgttatttcctttggaaatctacacgtttacagcatatgacactagcagaagacgtcaaagccatgcttactgaacttcgaaaggaggtccgcctacttctattaacgaatggggacagacagacccagagggagaagattgaggcttgtgcctgtcagtcctattttgacgctgttgttgtaggtggagagcagagagaggagaaaccagcaccgtccatattttattactgctgcaatcttctcggagtacaacctggggactgtgtgatggtcggtgacacattagaaaccgacatccaaggaggcctcaatgcaggattgaaagcaacagtctggatcaataaaaatggaatagtgccactgaagtcctccccagttccgcattacatggtttcttctgtgctagagttacctgctctcttacaaagtatagactgcaaagtcagtatgtccacttaaagcacataaaagggcatgattatgaatgttagaatcaatttgctgagtatgaaataagaaaagttagggcactccacttatgataatccagctctaagaataattttacttatgatttaatggccaatattttgaaggtcttcccaaccctattgcttctaagttgtaacaaccaaccattgagtggtacttatatctgaaaattcagattgcatgaattcaggtcagtagtatagcccagaaaatttaaggaaatatattatttgttagtctgtatctggagctttttaaaattatgttattaatcttttagtatcttggctgcataatgccaagcaggattgctttacacatggatgcacaaatgtaaggtttatcttctggcttaaaaatagatatttttaaaaaatagattttctaaaacacagatttatgaaagcaagtgaatctggttaatatgaaataagtactaagtcacatgcaaatcaaggtattatatagtgaaattattttgcatattttgaaaacataaaccatagtttttgcctactttggatgtatactttcttttatgaacctgatttttctgtatgacatttttttttttttcagagggcagggagcaatttttctatggcatgtgacagattcctccagttagaaaaagctgttaaaatcaacacatggtgctcctttaccgtgacattttctcacctgtgcacagtgagccggtagcttccttttagtcttcacctctcaaggaaatgtttttactgtcttttcccagacacacagtggggttgagggagctaggctgttttgctagagataattgcaaggcacgtggcactaaaagtcatttttcttctgtggatccataagaggaacatttcctcagtgtagcctaacaatgcagcccccaatctgttcctttttttttttgaaatgggatctctgtcgcccaggttggagtgccatggcaccatctcggctcactgcaacctttgcctcctgagctcaagtgatcctcccacctcagcctcccaagggtgtgtgtgactacaagtacacactaccacgcccagctaatgtgtgtttttgtagagatgggattttgccatgttgcccaggctggtctcgaattcctggattcaggtgatcctcccacctcagcctcctaaagtcctaggattataggcatgagccactgtgcctggccccctcatctgatagaaaattagattttgctatgagccatttcctgagggccaatttaatactcgtgtgactcttcttagagttaccatctgccttaaatttcctctgtttttcacattcttggaaatatatcattgttttgcaaatttctatatctaattcagggtttaccaggagcttaataattaatggctacatagcaaggcatcgtcttggaactggagaattttttttagactattaggctagacagtctcatgattatactaaccaaacctggagtaaagtggttg

SEQ ID NO: 416 - DNA, 2167 bp, Homo sapiens
taataccttttaattattgttgtacttcatttaaattgccatgtgtctctggagaatttgtaattttcttatgagtaattttcttatgagtaattttcttaatttatttcagatacttttgttgtcattgtaaattgtatctttttccttctgtgtattatttattaacctggacttttttttttttttttttttttaaacagtctcgctggcttccaggctggagtgcagtggcatgatcttggctaactgcaacctccacctcctgggttcaagtgattctcgtgcctcagcctcccaagtagctgggattatgggcgtgcgccaccacacccagataatttttgtatttttagcagagacagggtttcgccatgttggtcaggctagcctcaaactcctggcctcaagagacccgcccacctctgcctcccaaagtgctgggattacaggtgtgagccaccaacgctggcctaccctggtcattttttatggtcttttttccttgcttgtgttttcagttcttgctttaccttaaactcttcaaatgttattttatgttttatgtttggtaatgtcagtatctgaagtccctgaggaacagtgctgctatttgttggttctattgacttatttctggtggcataattccttatatgttttgtaattttgaatggtatgcttatatttgattgaccttaatcatcaggaatattgggtggcttaggttgtgtcttctgtgttctctggcaggtcttctctcttctcctcaatagaacggtgtttgcttttgccaagatctatagggcacagcaatccaggactactttgagttttctttggcttatggtttcctagacttgcaggtagggtaaattcaaacctcgaacctgcatgagggtaagactgtccatataaattctcaaaagagggagactttacctctacctgaagctgaagttgaaacagacaaattattgctgctgcttcaggtatttttcttagcccatcctttcactaaaagtgtaaccaccaatcctagtgatccagcttcatctcagttccaactccttatcttgagcagatccaagactttatctcctctgcctcatacagccaataaaaacaatttctaggtttccagtattttcattagacttatcacatagctactgcttactagtatgatggggttttaggtaagtagacccaatgttgtccatagattggaaaaaaatatatccatacaatgcaatgttctatagttactaaaaatattttacatggatatctaataatgaaaattttcataagtgccaaatgcatattttttttaattaaatgaaaacaaaactgaaaaagactaagtgtgtttgaacctagtcgaggttgtcaaaggaaaaggagaagagatgtgtgtcaaggacacatccttacaaatacctatatttaaggggtacaagaaaattaaaaaaaaaaaaaaacaaagctacttgaaccaaaggctagtgtcttggaaaaccatggtataagagagtgtttagaagatagaacatacatggccacttgtctctttaaatgcagagaggaaagaaaatcaggaccaagaagatgcctttacattaggacttttgtctcttagattttgtacatgctagtatcaggttttttgttatgcccaattcccaaactgtgtgttatttttctggccttagaatttctatttcttcatacatggtctgggctgttgaaaacaaccagccagtctcagaatctagtgtttagttattacatggattctgaactgattaagaaccaggatagcagtattatttcagaaattcaaccaagtgtgaggattagacacttgagcaggatgctttgttgtttagtttaacttactaggcttattacattttttcttttccttttttaaaataaataatagtggattgttctattactccttgactaagcacaagcagctgagaagcttccaagctttggggcctgggcagagctaaactggggaaaggcttccagcctttctttttcagatcatcagttgtcttcctaccaccggactttgttgcctttccagagtagaagaaaaacagaaaagacggttgaaaaataacataaaactaagcttaaaaattttacatcc

SEQ ID NO: 417 - DNA, 1970 bp, Homo sapiens
agtgatagtgcttttaagatgtttaaagttggctcaggattaaatgagttaatatgggaagtgcggaggcccagccagtgcaagcactgaagacttttcatcttgtcggaggccgcccatccctccccgggctacctctcagggggcttcgctgtccgacactggagcctccatttcccccttgcggtccccacatgcaatgcccctgtcttgggacagccctgagggtactggagggcagggaagcgttcgccccttgggaccctgggggaggagcaggtggaggaggcagagccaggagggcgggcctagccggcgcctggtacatagtaggtgctccataaatgtttattgaatgaatgaatggaggccatgcaggcagaggcagccgtgctgcgcaggcactggtgaaagagcgggtccagtggacactggtgacaaattctaccgccagtaatcacttgtgaaaaatcaacagtgaagcccagtggctcccggtcccccggagaaatctgagtggatttccagaagaacaagtccaatctctgccctgctgccctccatctgtctatttctctcctagacttcggcttcagacagatgtggtttcaaagctgcagtcccggccttcctgagctgtgtgaccttggttacgtccacgtgcccattgcctcgcctgggcctcacttttctcatctgtatcatggagttggcaccaccggctctgccctcaaggtttgccgcgcctgcagaggcccctgagcattcagcaggtgctcactcagcaggagctgccagacgttgaatgtgtgatgggaatcattggatgctgccgcctctccgcccacccgccacctgacactgcctcctggctctccatcactgcccaggagtcgggcagcctccccgctccctgctatttcttctctgcacctgacgccgcctcctggctctccatcattgcccaggagtcgggcagcctccccactccctgctatttcttctctggagcttcccaggaggttaatagcagcttctcaccaggatatttggctttttaaggaatctccttgcctctttcttctctgtgaggatattctcaggatggttgcggtggagaagggaaggaaggagactctcgaggcatttgccaactaaggggggcacttaggggtaggtggggggggccagttccgggcagaacttggggcagacagtgccctgtttccagaacagctcccagtgccgggctgggctgggcttaaatgcagtgggagaagctcaagggtggggtggggtcacaggctccacttggaatgggccaggtcatttgactatgggggcatttctgagcctggtggggcctcagtctcccctcctggaaggtgggcctgatgatccatgccagcctgtaaaggaagggaaagagttttgctgagctgcagaaggaggtgcagacaaggcgaggggctgggtgttgggggaggccagctgagcgcccaggacccctctggccccaccccaggtccttgggctccaactgctctcagccctgccctgagctcaggaatgggcccaggcctgagaaggaggtcaaaactctgcagcccttccactactacttcggggggctcagcacagctcctctgggctcaggtccccaggcctttccctgatgtaaccccccagtcaggcccgcacagtaggggaggtccacctcttatgtgtgtgttttaaattgcggtaaaatgtacgtaacatgaaatttaccattttagctctgtaagcatacaggtccgtggcattcggtacattcacattcctgtgtggccatgaccaccatccatttccggggcttctgcatgatcccgaacagaagcttgcacgccctgcgccacgccccctcccatgtcaacccccgtaaccgctggtcttcgtctctatgaattaaactattccaggtacctccc

SEQ ID NO: 418 - DNA, 2266 bp, Homo sapiens
gagtgcgcatgcgcagagcggccaacccgtgagggagcgtttctgacgctaggtcaagggcggtgttcctgtgttcttagggccccaggaggcgagtctgagtggaacctggctggggtaggctgaaaggtgacttcgacgctcttctgaggcctcagacgtgtgtgatgactgccctgtagaatcagtgctgtgaccccgagtaacaacgcgcgcttgagttggtataaactcctgaagtttcaggaattagtgacattcagggatgtggccatagacttctctcggcaggagtgggaatacctggaccctaatcagagggacttatacagggatgtgatgttggagaactatagaaacctggtatcactggatttggatttacagtgtgagataatcagctacatagaagtacccacttatgaaacagatatatcctctacacaacttcagagcatatatgagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagctatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtatgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaag

SEQ ID NO: 419 - DNA, 2398 bp, Homo sapiens
tcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccatttcttccgtttggattcttggtgcacgtgtgatatggtatttaaaagcaaagacaagcaacattgtcaaaaagctgtccttgccccccatcccccacccaaatcttttttccaaactcccccagggatcttccttaccccactggcagagcaaacatccaggggctgtccatgtggcttgcgggctcccagagaaaggaattgggccaactttgtcctgtgggatggaggccccttcacggcctccctcgaggcaaagttaatttgtagggtcaccattatgttgagtcatgagcagacagaaggagagaaaaggccatcttccttaccttcccctccaacttatcccgtaccctcccagggaaaatggtaccagactgagccatcaaaatcactgacaaagtttaggtgggaattttttttgcatgttggagagagaagggcttaaggtagcagggaagaagggggctttgtggggtcctaaattttaaggaataagtagaggaagacaagaaacagagtggtaggctggtcatttctcctggccacaagtccccccagatgcagcttttacccattctttgtccttccccataaggagagaccctgacatttcttggtagctgcaaatagtgccactaagtgaaggtggccatcatgccagttacttcctcaggaaaatattttcttgccttcttctttcagtatggttttaaatttgggaacagtggataacccaagtgtcccacaggccaaggtacattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatgggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatcccccccagccatccctcctggtcctcgtctacatcaagggcctcttcccctcttcctcccagctctcaggacaggtgactgggagaccttgaaccctcagcctcttcctttaaaaaaaacaaaacaaaacaaaactgtgggccatttatttgggattttggagttgtttggtttttgtttttatatcttaatagttcgaaagtaagaagggagccctgctatggatgttaagtccaaattactcggttagtgggagcaaaacctatgacttccaaggggatgaggagaggttcagaggacaggaggagcctccccc

SEQ ID NO: 420 - DNA, 3218 bp, Homo sapiens
gtttccttatttatcttttagggtatgctttttatttgagaaggggtggggtaaatatgggcaagaggtgagttttgctcttacctgcaatcctttgtccggtttagtttgggcccttacattagctgctttctctctctgagtatgtgtttgtaactgaaagctaatggtgtggagaagctgtgcatgtgccattcttttaacctggctcataaggccaaggcatttttactgctggcagcactagctccagcagtaaaagaactccctgaaagaactcctgagacaggcttccctatttccagctataatacatctttggatcaagaggatcagtttttcctgtaacgtttgctttggtttaaaggggaccgtgtaactttaaaatttttttatttttatataatttcatacttactgaaaggttgtaaaaataggacaaagaattccccagataccttttacccagatttccttttgttttcacattttactacatttgctttttttttcttggagacggagtcttgctctctcgcccgggctgcagtgcagtggcacgatctcagctcactgcaagctctggttcctgggttcatgccattctcctgcctcagcctcccgagtagctgggactacaggcgcctgccaccacgcccagctaattttttgtattttttattagagacggggtttttcaccatattagccaggatggtctcgatctcctgacctcgtgatccacctgcctctgcctcccaaagtgctgggattacaggcgtgagccaccgcgcctggcctacatttgcttttttagctgctttctgcctttccttcgctttacacatagacatacactttttctctgaactatttaagagtaagttgcaaacatgacatctttttaccccaagtgtttcaggacatatttcctaaatataaggctctcatgtaatcacagtacactgagcaacatcagtaacaacactgaaaaatagttaactaattaatccacagattttattcacatttcaccatttcttcgagtaatgtgcttcactggaaaaggaaatatagattatgcgtttctcatgctgttgtcctatatctttagccatttttaatctggaacagttcctttgtattgtatgagagttaaatttctcttcctttggggatattgggtatttcttcattgtgagattgaggtctgtgcgctgttgatagaaatcctgcagacatgatgctgagctctgtcagtgcatcacctcgggaggcagaggccgtctgtggctcccatagttgaaattctgcagttaaatactgtgtcccagcagtattaactgcagcaacttggttagggtggcatctgcagcttcccctactggaaagctagcagctgccttttcctgtatgccaggtggtatcaacagtggatcttgatatgcgttgccaaattatttgtaattcattttccttttttctctgaaaattcattgctggccttcttcgacctccttgttaactaggctgcttggtatgttcaaaggcatctctgttcctgtccccaggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcaggtaccagtagagaggaacacaagacgacgggcatcactcctcagccgtcctggggataactcactggcctgttttctggtcagcttttttaggagtttgagccctcgccaccctgagccctgatctaagtgtttggtaaccaggcttattgaattgtctccctccagggattttatggatccaacaatggacaacaccaagcatatattaaactatctgatgcccatcattgaccaggtgaatccagagctccatgacttcatgcagaggtacatatgtgtctgcatttctgtgtgcatgcatacacacgcccacacccccccacacctgaaacactcctcacaagccgagcgcagtttcctcattgtcttgggtggatttgttaagttctccccagttgttccagtcaccagcaatctgggtaattcagttcttggagcatttttggggactgtgctctttgggggacatagcccatcccttgagtttacatctagtggggagaggtggataaggtatgtatgccaaggtaagatgttgaggttattgccacaagagaaacacaaagtcctgtgggatccagtggcgagaagggggaggccaacaatgggttgttttatttcccaagtaccaaagagaagaaatatttttttgcaaatcccatgtgatgttttgtttcttctctgtttagttggaaatgtgttcttggccaatgcctctttttttaaaattttttaaaaggtaatggctatgccttctttttttttgagatggagtattttctcttgttgcccaggctggagtgcaatggcatgatcttggctcactgcaacctctatcttccgggttcaagcgattcttctgcctcagcctcaagtagctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttact

SEQ ID NO: 421 - DNA, 2297 bp, Homo sapiens
caccggtaccgtggtggaagcgcgccctgggctgccgggggcgcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggcaaaaggaactccttattaatcatcaaggaatttatactaatgagaaaccctataaatgtaaggaatgtgggaaggcctttaaatatggctcacgactaattcaacatgagaatattcattctggtaagaaaccatatgaatgtaaggaatgtggaaaggccttcaattctggttcaaattttatacaacatcagagagttcatactggtgagaaaccgtatgaatgtaaagattgtgagaaggcctttagtcgaagctcacagttgattgaacatcagcgaactcacacaggcgagaaaccctatcagtgtaaggaatgtggcaaggccttcaatcggatctcacatcttaaagtacattatagaattcatactggtgaaaaaccctatgcatgcaaggaatgtgggaaaacctttagtcatcgttctcagttgattcaacatcagactgttcatactggcaggaaactctatgaatgtaaggaatgtgggaaggcttttaatcaaggctcaactcttatacgacatcagagaattcataccggtgagaaaccctatgagtgcaaagtatgtggaaaggcctttagagtgagctcacaactcaagcaacatcagagaattcacactggagagaaaccctaccaatgtaaggtatgtggtagggccttcaaacgggtctcacatcttactgtacattacagaattcatacaggtgaaaagccatatgaatgtaaggaatgtgggaaggcttttagtcattgctcacaattgattcatcatcaggttattcacactgagaaaaagccctatgaatataaggaatgtgagaagaccttgagtcatgattcaactaccgttcaacctcagagaatgcataatagagaaacacatgtgaatataataaatgtagaaaagccttccatcagcagttaccccttactaatcatcagagaatttatgttggcaagcaaccatatgaatggaagtaatggggaaagcccattagcctaggctaattgtgactgtgacttacttctccctcttggagaaagacttgaagaatgtaatgccagtgacaatgccttcattcagaggtaagcctttatcctaagtctgaaaattcatatcaaagaaaattttatggatgtaaattgttcagatcataattgtcaaaaatgctgggaaaggttgggagaaattttatttctaacacattccagaaccacattttctaaccacagtgtagtaattttatcaagagcaaaagttatagttttcttacaagttaaaaaaacagccagattatcatttgcttaacaaagaaatcatgcaattaccataaatggtaatgaaaagaatgaattgagagtttaacatgccaagagatgtgaaatgtggccaaagagatgtgagggtaaggggaaagccaaagctacactggaggaatttttatagcctttgaatgcatgcatatacatgaaaatctgaaagataaactcatatgcactaaacatgctattcaagtctaccaaacatccaggcagtgaaagaagaaagtaacagaaaatgatgaaataaagagaccatcttacaat

SEQ ID NO: 422 - DNA, 2180 bp, Homo sapiens
caggttcaagcaattctcctgcctcagcctcccgagtagctgggattacaggcgcccaccaccatgcccagctaatttttgtatttttaatagagatggatttcaccatgttggtcaagctggtctcaaactcctgacctcaggtaatccacccgcctcagcctcccgaggcatgagccaccacgccaagcccaggcttttctttccatcggaaaattatcatctcaataagcacttcagtaagaaaaaccacaacataatcatcgaagcaatccctcacggatggagttgaggccacttccagactttcctaatatgaagaaggcatcagatgtccctgtgctggctgtttcacttgcctgtgtgggaggaaccccgcaaacagggctcctggggcagagggtgtaatttacaattccccagtagcagctgctcatccaaagagctgctagcaatttacacccccaccaacagcacagggtgcacctgggtcacacgggttgtgtgtgagggttttctgattttccccaatcttgtgggtgcttagagtcaagcaccccttcggacaatcacaagctgtttgcttgtttttgcattcgaagctacgggcactgccttacactctaagtgcccatctctttcctcaccaagccgagtaggaggggttctgaggagctcccctgtaccggtgaggggactgggctcacacggggctgggtatggaagcctcgagagcccttatctgtctgcatcgtgctagacgttaccatgacctggacagcctccatcgccccgggggctctgacatgctcagatcccaggatggggctgcagttataggggtctcaggttggccttcccgagacaggcgtccctgtccccttgtgtccccacccttggctgtccccaggcctctcccttttcctgttttgatgctggctcagccaggcccggagacaggggcatgatgtcctaatcctccaggcgggagccaccatggagggttcccgtggactcagtcccctgccaagccacctttcccagcactcacatatgctccacctggcacatgatacacgtgggggctcctgagccccagcaccctgacttagtggggagggaccccaccggggtcccatgaagccccctgacttccactccaggcagcaagtcgggggaacaccagttgcctgccctggccgccagcacagcactcgtaaatcagggggtgtctggggcgtcggaaatggctgtgtggaatgtcggggtggggtaggctgggggtgagcccttaactcttagaagggtggggtgtggggcagaaggagcagatgcctggattcgagggtgcaggagatgggctggtgcagacgtggggcctcctggctgcaggggccggcagtgaagaggttagctcccagcccaggcagggcataaatttggggcacagctcccactctcaggacctgcccgtcacaatggccgtagggaagttcctgctgggctccctgctgctcctgtccctgcagctgggacagggctggggccccgatgcccgtggggttcccgtggccgatggagagttctcgtctgaacaggtggcaaaggctggagggacctggctgggtaaggacttccagggaccctctgtgacttcccaactttccccagccctgaccctgctcactgtcagcgcccttccctcccacaggcacccaccgcccccttgcccgcctgcgccgagccctgtctggtccatgccagctgtggagcctgaccctgtccgtggcagagctaggcctgggctacgcctcagaggagaaggtcatcttccgctactgcgccggcagctgcccccgtggtgcccgcacccagcatggcctggcgctggcccggctgcagggccagggccgagcccacggcgggccctgctgccggcccactcgctacaccgacgtggccttcctcgatgaccgccaccgctggcagcggctgccccagctctcggcggctgcctgcggctgtggtggctgagggtgcccggcctggcacccagaagctgcagtgctgggggagctcggctgacttatttattggagacctggatgcagagacaacgaggaggggagtgggctggggcgaccagcagtgagtgcaataaaggacaccactctcccggc

SEQ ID NO: 423 - DNA, 2452 bp, Homo sapiens
ttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaaatgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaaaaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacagcatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 424 - DNA, 3014 bp, Homo sapiens
caggtggccctgaattcattgcctgctcagcaaaataaaggcccagtgtggaagccggaacttgcatttgaagaaggatgggaaggatgggttgaggagggcccatccccagcagcccgagagggaggaggccacggagacttggagcattcccgtttcttccagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactgcaggaacttctggaggaaagcactcattgatctttcatccctaagatagtttgagagagctcacactggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacatgcctggaaagttgatgttggttgttgtcaggggaccttcagtcattaccatgtaggcctctttacaaggcccagctccttgacaatttggcaataagttctcgccaaggttagtgatccaagagaggaccaatacagaggccaaaatggcttttatggcctatcctcaggaggactgctaagctttcacttatttcctattgtgttggtctcacaacacaccaatcctgatacaatgtgagagactgcagaaggtatgaataccaggaaacagataactcagaagcatctgggaaatttgccatggaattaatgaagaaaagccctcagcacatcatccttctactctaatcaatatgaaatagcattcagtaactcctattaattcactctgaagagaaaccttttgaggacaatctgtatggtaaagctctcagctcgaattctcaccttcatgggcccagaagattatgtactgagagaatcctgaagaatggaacagctgtagaaagccttcagtgctatcagcagggattcatgtgacagctcacactaagggagaaaacctgtgaaggtctcagaaggcttcagtgacagtcatcccttaagacacactggaaatcacacaatggaacaacactcagaaatgcggaataccctgcagcaaaagtgttcacattactgagcaaactatagtgtggtattctgcagtgactatgggaaagccttgaatgttctatcggtttttaagggacttgagaattaattctggagagaatgccccattgaacatcatcaatattggagagctttctgtttttctacatttgttaggaaacttgtgagcattcacactacagagaaacttgaaatataaagaagaagagaaagccttcagtgatgcctctgtgttagggaaaatatggaacttctccctggatgcaaaacctatgagtatattaatattggaaaatttttcagtgattcttctctttcttgtatatgagagaacttacatggagaaacccctaggaatgtaatcagtgttaggatgcctcagcctgaactcttcactgagtggccacaattttcactgggaacaaaaagtataatcactgttttgagtgtgggatatcctttatcagtgtctcatctgtagattggactgctggctcattaatttttttagtctttttttcttttaatataaacatttgtgtatagctgttccctaaaataaacattaacatatttcataatttt

SEQ ID NO: 425 - DNA, 2411 bp, Homo sapiens
ctcactcggtcagttcctcgggcgagttacggggacgacctgcgggagcacgcgggcagtggccggacgctgaagcccaggagagcgatggagacgtatgcggaggttggcaaggagggcaagcctccctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagatgcctgcctgcgggccgaccgcgtcatgcgcgcccacaagtgtacgcagggcccaaggggtcctggatccccctgcccctctccccagcggttcaactccttgggggagagaagagagcagggcgtgccttgttgtttgtctgtggccacaagcaccaaggcttgacatgcagatgtaggggctctgatgggggctgttccccaacaggcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgaggaagctggagggccgggtggcttccgatgaggacctgaagctgtcagacatgctgaggtactacatgcgtgactcacaggcagccaaggacctgctgtaccggcggctgcgggcactggccgactacgagaatgccaacaaggcgctggacaaggcgcgcaccaggaaccgggaggtgcggcccgccgagagccaccagcagctgtgctgccaacgcttcgagcgcctctccgactccgccaagcaagagctcatggacttcaagtcccgccgggtctcctcttttcgaaagaatctcattgagctggcagagctggagctcaaacacgccaaggcagaagagcaccgccttcttgcgcttcttcacctcctctggcgttgaagacttacgcaccttcatgtcgttgaacaccttgatgacaccatcagagacagccacaccggaggcctaggagacatgccacgtatacgtcgagaaaaggattctagggaactgccccttgttttttcagaagatctcagtccacgtcccgagtggtcactagtgcccttcccaaggcaagtcactagttttcccacccaagtcactgtcaaagaaccagatgggacacaacctcagaatggcagccatggcctctgatcacctagttcaacaaccccttccctcattttacaggatagaaatgcaaaactcgtgaaaagcagaaccttgaccaaaatgtgaacccagaattaaaagatccaccggctactgactcatttgctactcacagtacttgctctcagcctttggataaaactggtgatttagaacttcggatatggaggacccaaacacctgagccaagactcctcttcagaaagagccaagaccccacaatgctagatgggaccccaaggacaccgaacagttacaacaaacccaccagaactgcttaatacagttactacacaaacgacccctgttcccagctaggctctttcccaaccaagacaagaattgcaacccccattaaggaccctgcccgacaactcccttcttccgggaatggtgctaggccccagaagtcgctgataaaaattaacatgccaaactc

SEQ ID NO: 426 - DNA, 2230 bp, Homo sapiens
tttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagctgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgc

SEQ ID NO: 427 - DNA, 3098 bp, Homo sapiens
aaagaaaatatggaaatgcaatagattcagaatcataagatgtagacacagaaggaatcttggagaacatttaaaacttagggaactcttgagacaaaatctcactctgtcacccaggctggagtgcattgtcacgatcttggctcactgtaacccctgcctcccagttcaagcggctctcgtgcctcggcctcccgagtagctgggattataggtgcccaccacaatgcctggctaatttttgtagttttagtagagatgggctttcaccatgttggccgggctggtctcgaactcctgacctcaagtgatccacacacctcagcctcccaaggtgctgggattgcaggtgtgagccaccacgtcctgccttattattatttttgagacacagtcttgctctgtcatgcaggctggagccatgtcagctcaatgcaacctctgcccccctggattcaagcagttctcctgccttggcctcctgagtagctgggattacagtcttgctctgtcaaccaggttggagtgcagcggcgcaatcttggctcactgcaacctctgcctcccgggttcaagtgattctcctgcctcagcctcccaagcagctggtattacaggtgcccgccaccacgcccagctaatttttgtatttttaggagagacagagtttcaccatctcggacagactggtcttgaactcctggcctcgtgatccacctgccttggcctcccaaagtgctgggaaatgacaggtatgagccactgcgcctggccagtgatctcttcttactgcactctgtgacttgccttgaattccttcctgcacaagatccaggaaccctcccttagggtctgggtagggacccctttttctggcaacagagactttaaatacttttatgactgcctctgatagattgttctacacatctgtcctttttgttaacatgattataggaaatgtaatttagggcaccaagagaagatctattcacggaacacaggagtgaatacacactgcctctgtattgatggaactcatgctgggccattaagtatttatccatgtatgcaaatgagcattgttttcaagatattgagcctctcctacctttccttctaactgatccaaatcagaataacctgattggtgagctgagcttcacctctaacttgacttgttgttgtgctgctattggtaatgaggtgattgatactaagggactttttatgttgacagtgtgagcgtctcacatgcatgggataggtagggtatgtgggccctgggttttgactaggtgagatgcgaggaaatacttttttctctctctctcttttttttttttttttttttgagatagagtttcgttcttgttgcccaggctggagtgcagtggtgcgatctcagctcactgcagcttccgcttcctgggtttaagcgattctcctgcctcagcctcctgagtagctgggattacaggcacctgccaccactcccggctaattttttgtatttttagtagaaacagggtttcaccattttggacaggctggtctcaaactcctggcctctggtgatctgcctgccttggcctcgcaaagtgctgggattacaggcatgagccactgtgcctggccttttttttttttttcaccattttttgagacggggtttcactctggcccagggtggagtgcagtgggactacaggcatatgccaccatgcccggctaaattttgtattttttggtagagatggggtttcaccatgttggctaggctgatctcgaacttctgacctcatgcgactcaccagcctcggccgctcaaagtgctgggattacaggcatgagccaccacgccctgccagatatgaggaaatactacccactttggcagagtgctttatccttgctaaaataccttaccccaaatgcaagaaacaaatcttattcctgtttgttttttgagacggagtttgctcttgttgcccagactggagtgcaactgcgtgatctcagctcaccgcaacctctgcctcctggtttcaaaccattctcccacctcagcctcccgagtagctgggattacaggcatgctccagcatgcctggctaattttgtatttttagtagagacggggtttctccatgttggtcaggctggtctcgaactcccgacatcaggtgatccgcctgccttggcctcccaaagtgctgagattacaggtgtgagccaccgcgcccggcccttattcctgttattatgtgcagatattgagaggcttagcacctgggccagcagctgctgtgctcaatttctcgcccggccttagctgcctccctgcggggcagggctccggacctgcagcctgctatgtctgagcctccccgcccccgccgtgggctcctgccctgcccgagcctccccaatgagcgccgccacctgctccagggcacccagtcccattgaccacccaagggctgaggagtgcaggcgcatggcgcgggactggcaggcagctccacttgcggcccagtgtgggatccactgggtgaagccagctgggctcctgagtctggtggggacttggagaatctttatgtctagctaatggattgtaaacacaccaatcagcattctgtatctagctcaaggtttgtaaactcaccaatcagcaccttgtgtctagtttagggttggtgaatgcaccagttggcgctctgtatctagttaatctggtggggacttggagaatctttatgtctagctaagggtttgtgaatgcaccaattggcactctgtatctagctcaaggtttgtaaatgcaccaatcagcactctgtgtctagctcagggtttgtaaatacaccaatcgacactctgtatctagctaatctagtggggacctggagaacttttgtgtctagctcagggattgtaaacgcaccaatcagcactctgtcaaaatggaccaatcagctgtctgtaaaacagaccaatcggctctctgtaaaatggaccaatcagtaggatgtgggtggggccaaataagagaataaaagcaggctgcccgatgctgcagtggcaaccacctc

SEQ ID NO: 428 - DNA, 2118 bp, Homo sapiens
attggtttcttacaatcccaaaaggtgcagttactagtattaatccttttttgccaatgaggaaacacaaagatgaagcaacttgctcaaagtcatacagtgacagtctgaattcaaatcctatacacttaaagtttatttgttttgttttggttttttttgagatggagtctcactgtgtcgcaaggctggagtgcagtggcacgatctcagctcactgcaacccgggttcaagcgattctcctgcctcagcctcccgagtagctgggactgcaggcacgcaccaccacacccagctgatttttgtatttttagtagagacggtttcaccatgttggccaggatggtctcgagctcctgacctcaggtgatcctcccgccttggcctcccaaggtgccgggattacaggtgtcagccactgcacgtggccaacttaaagtttttgatagataatacattaacgttaaaaattcaaaagataagtataggctctacagtacaaacccttctgcctcctagttcctctccctggaggcaaggtgatcagtttaacaatatttttttattttgagacagggtctcactgttgcccaggctggagtgtagtggcgcgttcacaacttactgtagcctcaacctcctggctcaagcaatcctcccacctcagcctgtcgagtagctggaaccacaggtgcacaccaccatgccaggctaatttttgtattttttgtagagacagggtttcaccatgttgttcaggctggtctcaaagtcctgggctcaagcaatcttcctgtctctgcttcccaaagtgctgggattacagatgtgggccacggtgcctggcctacatatgtattttttccttttcttccccaagtggtaggatatgatacacattgttgatttttttgtttagttatgtatctcagagcttattctttatcagctcatgaggaacttcattttttttttttttttgagatgtagttttgctcttatagcccaggttggagtacagtaacacaatcttggctcgcagcaacttctgcctcccaggttcaagcgattctcctgcctcagcctccgagtagctaggattacaggtgcctgccactacatccagctatttttgtattttcagtagagacggggtttcaccattttggccaagctggtctcgaactcctgacctcaggtgatccgcccatctcagcctcccaaagtagtgggattacaggcatgagcaaccgtgcccggctggaacttcattcttttggtataactgcatggtatcccatcatgtggatgtaccatgattcattggatgtggaccctcctgatggacatttaaatttcttccaatctgttgctattacaaaaagaaaaatgtgtgcatacatctttattcatctgtagaataaattcttagaagtagaatggcagagttaaaaattgtatgtatataattttttatagatattgccaaattgtcttccataaaagttgaaccaattttcactaccaccagcaaagtaggagaggacttgtttatccacaccctctttaatgtatgtaatcaaattttgggatatctgccagtctgttagggggaaatgatactcttctctacttttattttgcattctgagtgtggcagaggcaaagctatgtgcataccatagctttttctccccctgaaaacacaactaaactacattgttttcctggcctctcatgcatttaggttggggtcatattacttccctccaagaaaaacaacagttggtatgcctcctccacacttcccacaactgtggaagccagtgatccagatagcatagctattaatacaagatgggtgaaagctgctcaaccgcatcagacagcatgagtggtaagattttattgtgtcaaacgactgcattagttgtgttttgttattatggcagcatagcctagcttagccctaactaattcaataaataaagttgagcattatttgtacatttaaaagcgttttttatgtttgctttacagtggctttccacttttctatcagagaatcccccctcccttatgtaccatgctatattaataaattggaaggagctgct

SEQ ID NO: 429 - DNA, 2458 bp, Homo sapiens
acatttcccagtattatcgaagatcaagcaagaaagaaaaagacagaaaacaaatgcgaaaccacagcttccttggctctttttgcccatatgccgaagagccgagcattgccgccaagcattggcaccggccatgcggagactagcgaaagctttgcaattcctctacttctcagtgatgactcgggctttctccttacattcttgatgggcatgaccggtcctgtcagctgggtggccaatttctgttcttcagcagaactgtctcccttcttgggggccgagggctttctggggaagaggatgagtttggagcaatactcattcagacgctgcacattggcctgcagggaatcggtggacttgttctgcctcctcggatccacagagatgccagtggtccgggtcaccttcttgtgaatgcccgccaccctgagctccaggctgaagcctctgccggcgcgcaccttgatgtgataacgcacagcagggcacagcacaatgggccagatgggtcccgactctccgggcgcggggcgatgcagcgccctttggcttgccgggccttgattctgcggatcttctggttgaaccacgtggccacacgctgctgccagtccttgtggaagtggggcttcaacatcatgccattcctgctgggcgccatggctgcctacggccctcctacgaaggaaacactttatagatttctatagcagtgttacatagtaaggttttatggcgagttttgtagcatggatcatactaccttaggactgatggtaaagttttagtctaaggaaagctctgaaaatttgaaaatgtgtaaccacccaatgagttcagcttgcccactgcctagacagaaccatttatcaagacgggcatgcaaagccggctgtgtgggagacccgttttattattattcaaatcagtctccccaagtggattgcagtttttaaggataatttggtgggtaggggaccagtgagttgggaaagttgattagtcgggtcggagatgaaatcagagggagtcgaagctgtcctcttgtgttggcttaatttctggatgggggccacaagaccagatgagccagtttatcgttatgggtggtgctagctgatccatagagtacaggggctgcaaaatatctcaagaactgatcttcggttttacaatagtgatgttatcctgaggagcaattgggggaggtttagaatcttgcagcctccagctgcatgactcctaaaccataatttataatcttgtggctaatttgttagtcctgcgaaagcagtctagtccccaggcaggaagcgggtttgttttggaaagggctgctattgtctttgtttcaaagctaaactataaactaagttcctcccaaagttaggtcagcctacgaccaggaatgaacaaggacagcttggaggttagaagcaagatggaattggttaggttagatctctcactgtctcagttgtaattttgcgatggtgttttcaaatgttgatttaaagaagaccataaatttgtgttgctttctcagattttgagaataaggacaaaaagtgtatgttttaatgggagaatcttaagaatttcactactgaagtggatttctctgtccattaacagtgctaaatgttttgtatttcccagttggaaaaacaaaatctgcaagctttgaatgatacttgttattaggttttggtaacagctgttgtactattcccatttcaatgctcaatagccacacgtggcatgtcatacctaccaggtggacagcacagatatagaacattttcatcattgtaaaaagccctatttgacaacactaacttaaagtattaatcttttagaagagaaagcttcagtccaacccaaattacacaattttacttttgaaaatattgttgaaacaacgttcaattttttaaaattttggaaaactgaatgaaatccatttgtaaatgcgcaaatggtactggaggtggaaaactgaagccttgctatagttttagttttttggagggttatgatcaacacagagaagaaaagattcatctacccatagagcttcttgagaaaaattttctaacaataattttgaaaatttgtagtgaatttgttcttgccattatttatgggtgctttcatgtgcgaggcacatcaaagttctggggaatgacttaggcacaaccaaatggctatcttgggaagaccaaagtcctttgctatatatgagagttttgagatggcgactacctttctgtatggtagattcttgtttttgaatatgccctctgggttttcaaaacaaattgtttttacaatacctatagtagttatctagggcatattctttagcttcaaaaattctatctttagaatgggcttcaatattcataactgagttattttcctctaataaatcattaacattttcccatgt

SEQ ID NO: 430 - DNA, 2456 bp, Homo sapiens
ttttcgtcagccggctggaggagcatcggtccgggaggtctctgggctgaggcggcgacagctcctctagttccaccatgtccgcgggcggagacttcgggaatccgctgaggaaattcaagctggtgttcctgggggagcaaagcgttgcaaagacatctttgatcaccagattcaggtatgacagttttgacaacacctatcacgctagtaggaaatagaacagatcttgctgacaagaggcaagtgtcagttgaggagggagagaggaaagccaaagggctgaatgttacgtttattgaaactagggcaaaaactggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggaggtgatctattagcttcacaagcacaaaaaaagtcagcgtcttcattatttatattttacaaaaagccaaattatttcagcatattccggtgataactttaaaaattagatacattttcttaacatttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagatggcaaagcagcagtccgaccaagcccactggaattatcctttaattttacagataccacttgctgtaggctgtggaccaagatgtccagaattattcttgagcactgatgtaaattacttagatcttctttgaggtcagaattcagcgatcacggtaggcagtgcttgaatgagaaaagcctcctggtgcatcttcaaaatgagtcctaaagaacatactgagtacttataagtagcagaacataaaatgtatttctgactaacacaaatggtcctttcacatgtgctttattagactctgggagagaaaagtaaccaagtgcttcagaacaggtttttagtatttacttcttcatggtaagataatgaagttctaatgaactatttctcccaaggttttaaaattgtcaagagttattctgtttgtttaaaaagtaagaaacctctgtaagcaatagattttgcttgggttttctttcttaaaaaaataatactatgcaggcaagacaccataaaagtttaattccttacagaagaaccagtggaagaatttaaatttggcactacgatcaaaactactgaattagcagaaataacgatatctaaagcttaccagcaaaagaaccctcagcagaatagcaaaaactttgctcaggacatttgaggtcaaattgaagacggaagacggaaaccggaaaccgttttcttgtaagcccctagaggcagatcaggtaaagcatacatagtagagggaaaggagagaatggaaataaaactgaatattatgcagatttatgccttattttttagcattttttaaggttgggtctttcaggctggttttggtttgtattagatctgtatagtttagtgatttagttttatatttaagctacgattaatattttttctttggcgatatttctttgcttttttttttttttaacaactttccatttttagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaaaacattgtttgcaggaagaaaacttcgagttacaggtcaggaaaagcctgctgaatttatgttgtaaacgttacttaacacagtataaagatgaaaagacaacaaaagtatcttcatacttcctcatcccctcattgcaacaaaaccttaaactgggagaaccttagtcccctctctttcctcttcctcctccacttcccacttattgtcactttgtaatattcagagagcacttggattatggatctgaatagagaaatgcttacagataatcattagcccacataccagtaacttatacttaaagatgggatggagttataaagtgcttttataatacaatataattgctaaaggcaagggttgactctttgttttattttgacatggcatgtcctgaaataaatattgattcactatggc

SEQ ID NO: 431 - DNA, 2523 bp, Homo sapiens
tttaaaaccatctgtctccaaaccctaaatgtctcaggtgagcaactaagctgctcagtttatgtgactccccagaagttgaattttaacccagaactgactccaagttcattcttctttccacgacaaggagtcacctccttgtatgcccccaggagtctcccggattcctccgagaacagtggaatagtgctcctccccagagcacaggttttgccagtgaagattgaatttggctagaaaccgctgccctgctctctcttctcgaagcacctggaagtctgagaaggaactgggtggctggctctggtcacaaactagcagccagaagcaccccttgtcagtgatgcacccccagtccccctcaagggctccaagtaaacccaaagctgctcccctccaagaagtctggggccaccctagggaaggcctcctggccttgactctcagggggtctctggggttgcggtttggggcccgctgcttccgccctttgcccccaggtgggcctggcagggctgcagcacagctctgttgctgatagacagggtggagcacttggcgaccttgccctgcagccctgtcattttgagttcagaggtcagatttgagtaataaacatcttctaaggacttgtcattctttctgaggatgttgctggccagccggaagacgaaaatcaccgcgtagatgccgatgatggtgagtatataccaggcagcgctggttccgtctggcaccttcagagccctggtggagttggtgtcattcctcccctctgtgtggtcacccagcaggagccccaggagggtgctggcctgggtctggttggaggcttcatggggagtccacttggcccctgagaaacagagaggtccggatgagatccagcgtcctgggctgagggctgcctggccacaccaaggagaatggagccctcatatccgtgaaaacgtgtcgctgctcaaagaggccttctctgaggcatgagcaggagtgtaacaacaggtatgtcaatatatttttaaaaatcaaaagagtccaaaacactattttgttgttgttttgttttgttttttgttttgtttgttttagagagacagagtctctgtcacccaggctggagtgcagtggcatgatcataacttactgcggcctcaacctcctgggctcaattgatcctcctgcctcagcctcacaaatggacatgcagcaccatgccgggctaatttttttcttttttctctctctttttttttttgtggagatagggtcttgccatgttgaccaggctggttttgaattcctggtctcaggagctcctctcaccttagcctcccaagccctgggattgcaggcaggagccactgtgcccagaaaaacactaagttcttgaataggagacacaacatcataaagatgtcagttatccctcaaataatttatacaacaaacataattgcaataaaaacagcaataggatttctttgtgaaatcaataaactattcatttagaaaaatcaactgttggccgggcatggtgtctcatgcctgtggtcccagcactttgggaggctaaggtgggaagattgcttgagcccaggaggttgagaccggcctggccagcatggcaagaccctgtctctacaagaaataaaaaaactggccaggtgtggtgtgcaagcctatggtcctaactactcaggaggctgaggccggaggatcacttgagcccaggaggttgaggctgcagtgagctgtgttcacaccactgcattccagcatgggaccctatttaaaaaaaacaaaaaaagaaagaaagaaaaagaaaaagaaaaatcaactgtcaagactaattagaaaaaaaaaatctgaataaaaagaatgactaatgaattagcctagccacaaattttaattcagccagctataaaaactaatttacatttttttcaatgaatgaaagctttatatgcacaaagcccagctgggacttgctgggctttgcagagtgtgtgggctgggggttcttcagaactaggtacaactctccctataaaactacaacagtgctgggcatggtggctcacacctgtaatcccagcactttgggaggctgaggcaggtggatcacctgaggtcaggagttcgagaccagccctgccaaaatggagaaaccccgtctttactaaaaatacaaaaattaaccaggcgtggtggcacacacctgtagttccagctactagggaggctgaggcaggagaatcgcttgagtccgggaggtggaggttgcagtgagccaagtgatgcctgtagttccagcaagacagagcaagactctgtcttaaaaagtaaaaaaataaagaataaaactacaacagctaaaatagtgtgatgcctgtggttccagctactggggaggccgaggcaggagaatcgcttgagtccaggaggtggaggttgcagtgagccaagatcgggccactgcactccagcctgggtgacagagcaagactctgtctt

SEQ ID NO: 432 - DNA, 2890 bp, Homo sapiens
gaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaaaaatgcagaagaatcaaagcaatttcttaatcagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacctcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacgagcagagatattaaattataaccaactttcaatttcctgtgctaattaagggaaattctgttgtggataatcaaacatagccaataaatttttttaaaactc

SEQ ID NO: 433 - DNA, 2025 bp, Homo sapiens
atttcctgttttcttcctagaccagtgggtcctccctggaccccgggcgaggttgggaggtctcggggcagctgagcgtggccccaggcgctcaccccatggctaccgcgttcatgctcaggttcctcacatcttggggtgtggggtactaaaatttcgacaggaggggtggttccacccctctcctccttagctcttttccctcctccctgcatccaaagaggacagccacatcgtgctccccctcctgtggggaacacgtctcactttcctctaatctctccctgatcttacacgaaactcgtctatcggggcgggttcttcctccatctctcagctccttggaggaaacaggacctcctctagaagctgaaggggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgagggtgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagatgaggacagaggcgcggtcatcagatgaggagaatgggccgccctcttcgcccgacctggaccgcatcgcggcgagcatgcgcgcgctggtgctgcgagaggccgaggacgcccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctg

SEQ ID NO: 434 - DNA, 1705 bp, Homo sapiens
agccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagttgtgacatcctctgagcttgccttctttgacccgtcactcctccacctcctttatttccctgatgaccagaagtttcccatctacatcccactcttcctgcctatggctgtgcccatcctcctgtccctggtcaagctcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgat

SEQ ID NO: 435 - DNA, 2128 bp, Homo sapiens
tatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcctccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgccccccgaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaaaataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgatttttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctgggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatctgtctcatctgttgcactgtatttcaatcatctgtaattaaaatgatcatatgttt

SEQ ID NO: 436 - DNA, 1981 bp, Homo sapiens
tagaagaaaaagaagaagaagccagaccaggaaagtgaaaggaaatggatatcgctgctggaggcaacgactaatttaagcagagtaggagaaaaactcttttttttttttcctttgtgccagttccttttacacgacttcagaacattctatgacaacccagcgtgcaacttggcactgtcagaagagtcctgggaaagaaaggaaatgcgaaaatgagaaaaccaatattggactgtactggacaggacatatgtactatatcagattctccctggccacatgcatagagtctctgtcttttcccaccactttaaagacattgataaaacgccataccacagggcatgagatctggcatcccaagttgccaccagcaaacctagaagtgtgggttccaactctatgggtatatctcagtcatttagcatctgctctatctttgaggctgagtttccagaagacctgattcaaccagaagcaaaagacagtagccaagaagatggcacagcataagaatcttggaaattgataaaaacatcccagagatatccaacaaaattagtaactatgtgaagagattctgtaatattgggtctattgggctctgtgggaaggtattccctttggaaatgactgaaatggaaattttgaaccactttcaatgatacaagtttggggttaacatggagatggtgcttcacagaagacaccacatttcaataattgtattcttatcgaattgtttaaaattggtcagtgactaatattaagcctctaagaacaaaattcattaggtttatttagcctgtttttgcattactgctacaaaatccaatagtttaaatagctaactgaatacttttgatgttaaagagcaaaatttcatgaagattttagatcaagagagctaccactgagaaaaaacaatgcagatttgtggtaaagtcccatgaatttgttgaactgccaaggcttctgatcatcactgctgaagaacttctaatggtgacttccatctcagctttctcattgccaactattaagaatgtatggattatccagatgttgcaacacagttgtgtttttggcttcaccactccctctgggctgtgattctgtttttttttcttttattgttgatgttctttgtttttaatatgagaaagatttgtgtattatacttcagttttagtttccttaatcacagactagacaaaagaaaattggcttggtttcctattaggaaaccacttagaagccattatcagaatcgtagaccatcactgtgaactatatccaggtgttgtcatgaaagtatgacatcctagagtggaaaagcaacctgggtttccgagactgttttactcttttatctggaatgttgttttagctgctatggctccaacagggtgaacatagcattttatttaatctaaatatctttctgctttttttttctaagttgcaaaaagtcaatgaccacatttcatctctagcctctcgtgaggtttaaattacacaaggaagaaatatttacaatgtcaaatgttgaagattgtttggagtcagaagtgattgttcagaatctgtcttaatgacaagtcagaaattagacaaagagatgaaatgctaagcccccaatgtgttctgaaaagttaaataaccatcttacatcagttggtacgtttttgtaagagtccaggatgtaaaagtgataaataaattaatgaaaagcacttttaaaaatcaacaaaagacatggcaggaaatggaagaaaagagaagcaagggatgcattctaatagatattaagaacaagccaaagtgcagtatttgctctagggttttactgttcattgtgtcaagactcacagattttagatattttttttaattgggaaagtaaatgaggcaggtagataagtagaaaaagttgtgtgaaactcatcagtactgaaaataaatagttgtacttctc

SEQ ID NO: 437 - DNA, 2121 bp, Homo sapiens
acacaccggggccgccctgtcgggacatcccggtccccacagcaatctgcaggatgctccgaggctaagactcccggggcctggcctttcactagggcacccacgccagctgcctcccttgctttcccgagccctaatcggctcctcccgacagtgactgccagtcacttggcaccctaactgtgcctctcttcgggccgagcaaacgggaccaaggacactctctccccttcggcttctcacagcgtctcccgcttccctccgcctcccggccttctccggagagcgcgcctggaaaaccctgggctcggccgcccccgcccgggagccggttcctgtgtctttcgcggggttctggcggggaaggcgatgggggtggcgcgcgccctgttccggccgacagggaaatgaaaagtgcaggaggcagcggcaggagcctcctcccttcccctcgggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgtcatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaaacccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccagaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagagaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaatgaagatgattgtgaaat

SEQ ID NO: 438 - DNA, 2457 bp, Homo sapiens
agttggagttgcggcggcgggaacgattgggctgagcagaggacgacatgttgcttttcgtggaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcagatcagtggctggggtgcctgttgtgggtgtgagtgtgtacaagagcgattgaagccaaatctgttgtcatgttagtaaatgatttgaaaactg

SEQ ID NO: 439 - DNA, 2427 bp, Homo sapiens
ggcctttttttttttttttttgccaaagttaaaagcgcatcaaacacgcctagcttttattattttaatcacaaacctatagacccctcagtataccctccatggggcctggccccagcaatccaaagctgacaaccttgggtgtaggtatgaggggtgggaatggaggggggagtgtctcttgataactctgaaatggggtgattcctccaaatgaagaaagagtgggagaaagagttgtcaattagccaaaaatggaagagacagaaagtagggagttgggaggctgttgcagggaaggagttccccatggggggccaggactcggggtgaggcaggcctgcacagcacccgggcaatgcacacgctctctggcttacttaggttgtgattgtctttcttctgccgttccttcaaaagggcctttgcctcggtctctggaaaagagtggagtgatcagggcctctgagcacaggaaggcaagaaacacatgcagatactaaggtagggtttggtagccaaaagcaggggaaatgccttttttaaaaagtgccttctttttactattttaagccatggtgataggctggttgttaaatccaagacgagaggaactgaagtggggtgaaagcaagaccacaagccatagggggaaaggggacaaacagcctccatttccatatgtccaaaccattcccctcagaatcaggcccatctctagacctggtaggcacagggctcacctggggtaaagtgtagggccatggggccaagaccctatcacctaccagagatctcccgtttgatgttgggcagctcagctgggcaggagttgctgacagtgatggctggtgtggccacgccttgactactgtacacatcaagcagattccctgacataggcagctgggggcagagagggcagagaaccaccagttgggaacaaacccaggcttggctcctcctcagaaccaggttcctgagcttccacatatcccaaagatggggcaccctctaatgcaaggactggctgactcagcaccagaacccttgcttctccttcaaggcaaattcacatggcgaccaaacagggaggacagagcaaactggacctaccttgcttcgctgggagactggagcctgcctggcctgcttatcacttcctccagtccctcatatccctcagtgacctctaaagcccctttcccaaaccccggggctggctctgagaagaaatgctggaaaaccacccttctcaggtctttgtcggctctgatgggacattccagtccgttagctcctcccagcacaacattccaatccagcattcttggaacactccaacccaatcttctccgaccttggtaaattgtcatgacaacattctatccaaaatctggccttctggagaattccaacctaatctccagtctttcactctgatcaagttgtaccatcttccactctgatcaagttgtaccatcttccacatcagggtctcctgctgctgtggaccaaggtcctgactccagtatcttcctgcacattctgttctctcaggagattcttatccaactattcaattaacactgctttatgtcagcctagtttttttttttttcctctccttcacactttcctggatatactccagaggagcacgtcaatcttaagtatacccagggccaggtgcagtggctcacgcctgtaatcccagcactttgggaggccgaggcgggcggatcacttgaggtcaggagttcgtgaccagcctggccaacatggtgaaactccgtctctactaaaaatacaaaacaacaaaaaaaattagccgagcatggtggcctgcacttgtagtcccagctacttgagaggctgaaacaggagagttgcttgaacccaggaggtagaggttgcagtgagccaagatcacaccactgcactccagcctgggtgacagagcaagactttgtctcaaaaacaaaaaaaaaaaagatggccgggcgcagtggctcacgcctgtaatcccagcactttgggaggctgaggcgggtggatcacaaggtcaggagattgagaccattctggccaacatggtgaaaccccatttctattaaaaatataaaaattagcggggcgtggtggtgggcacctgtaatcccagcacttggggaggccgagacgggtggatcacctgaggtcaggagtttgagaccagcctggccaacatggtgaaaccccatctctacaaaaaatacaaaaaaaattagctgggcgtggtggcgtaggcctgtcacctcagctactcagaaggctgaggcaggagaatcgcttgaacccaagaagtggaggttgtagtgagccgagattgtgccactgctctccagcctgggtgacagagcgagactccatcccccaccgccccgc

SEQ ID NO: 440 - DNA, 2783 bp, Homo sapiens
attcgaggttttttcatgtgtcaacaaaccacgctcacaattatttttgagacaggcttctctcccaaggcctaattgctggtatttagggtatgtcaggctaccgtgaatcaacgccctcaagcctcctaaatgcccccttttctagttgtgagggtctgtgaggcactgctttaagctatacccttgatttgatctttactatgagtccatggcttcctggcagtgctctggatttgatctttgctcacaggctgttacttaatttgggattcttttgctagctggagaggatagaggcgagaaaacattttttgttgttgttttcaactaacccagtgtttctgaaatatgctacgtttaattaaattttgttgcctctgaattctgcttgcaaactggccagttattttctgagctaattcttcatgtcttacagcaagcttagaatatgcatctaacagcaaccagttcatgctttcaacatttggagttttctttgctcaagtccataagttcactgagcccattttctttcttccgtgttactgcactatataacatagcttttcatttctccagcctcatcgccgtcctctgcctcgtcttggaactgataccatatttcacaggtctttgttacggtagcaccaactcctggtgccaatttactgatcagctttctattgctgactaatagatgatcataacatctcggtggtaaagaaacaaaaaaagcaattatttagcctaagcctctaagtcctctgggctgggctgatctaggatggttctggctgatggctctgctgatcttggtcattcctgcaactgcagctcagctgggcattggctggctgatctagaatagtcccagtgagggtggcttagctgggcccctttggctgtccatgtcttgtcatcctcctggctagcctggaatgttctcatgaaggcagaagagcaagtagaagtgagcaaggcctcttaaggcttaggctggaacatggtacgccctcactgcagcctcatcctattggccgagcccagagccaggagcagggatgtaggcagtacttgcccctttagtgggaggaactgcaaaatcacacagcaagcagtgtgggtgcagggaggggtgaagaattgggtttgataatgtgctgcaatagtcatgtcctgtctgatatgtccgcagaaccctgcgtttctttctaaagccttttttcatccatggtggcaacaccgcaacagccctgagaaatgtcagggcaaggaagatcatctccatctgaccagggaggcaaacagagacagagagattgagagagacagaggcagagagagagaaacacacacacacacagacagacacagagacagagagattgagagagacagaggcagagagagagagaaacacacacacacacagacacagagacagagagattgagagagacagaggcagagagagagaaacacacacacacacagacacagagacagagagattgagagagacagaggcagagagagagagaaacacacacacacacacacagagacagagagattgagagagacagaggcagagagagagagaaacacacacacagacacagagacagagagattgagaggcagagagagaaacacacacacacagagagacacacacagagacagagagattgagaaagacaggcagagagagagagaaacacacacacacagacacagagacagagagattgagagagacagaggcagagagagagagaaacacacacacacacacagacacagagacagagagattgagaggcagagagagaaacacacacacacacagagacacacacagagacagagagattgagagagacagaggcagagagagagacacacacacacacagacagactcagagacagagagtgagccaagaaggaaaggaatggtgggatggaggggggcgtccctgtagggggaccaaagaggggcttggggacggggagctcagtaccctcctccctggctcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactccagcttatggtgttaaaatgcagtgaggggccaggtgcggtggctcacgcctgtaagcccagcactttgggaggccgaggtgggtggatcacaaggtcaggagttcgagaccagcctggccaacacagtgaaacccccgtctctactaaaaaatacaaaaaattatcccggcgtggtggcgggcgcctgtaatcccaggtacttgggaggctgaggcaggagaatcgcatgaacccagtaggtggaggttgcagtgagccgagatggtgccattgcactccagcccaggcaatagtgctgaggtgggatcaggagttggagaccagcctgggcaacatggtgaaaccccgtctctac

SEQ ID NO: 441 - DNA, 2262 bp, Homo sapiens
gtgtcgacatcggcgcgcgccgagcccggaagaggcgcgggctaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 442 - DNA, 2141 bp, Homo sapiens
gaagccagaaagtgatggcactgcctcactcagctctgcctcgatccaacgtctgtgctccttcccgtccagacaagctgctccttaacgatcagctaacacctaaacaggcatggtctccagccaggtgaagtccctgccttgagtagcaggatgtgttgatgataaaggaaggaggagtttccctgcacaacctttttttgcctgctgccatccatgtaagatgtgacttgctcctccttgccttctgccatgattgtgaggcctccccaaccacatgaaactgttctcgggagtaggctgtggacaactttggggggccattattctgtctaccatagtgagtatcagtaagactcggtcctccttgccatctcaggtccccacgccccagtcaggcatgtatactgactcttggctcctactctgctagacgaccttgtgactatctagaagtacagactcaggcaccatcccaggaggtggggagtggcagctgcagctgcatgccacaaggaccccagattctcagcaaggattctgggcttttgtgattccgaagaaagagccagcaacaccaaagaggacagttccaccaaaagatcttaaaaaatgtaaggctcaggcaattacccattaatcacaaaacctcaatacaactccagggccagagccaaaggcaaggatggcccttctgcaaagatcactctggctgaaatttgacttatttttccaccaaagattgactttgatgcttaattgaatctgattccactgggataaaaaatcttaattggagaagagtttgggggcatttactctatttcatgcatcaccagtgggaagtttgaagcggcatattttggttaaatatcaaggacttttgaagagcaagacctgttcagggttgaagaggttgcctcatgaaaaagtcagctctaagcctccactcacgttcagggacggggaagaacacccaaacaggttgctccagaaaggattctggactcagaacccaaactggagggaaataacacccgaggaatctcttccattgtccagaagaggtgctggcactttcatgtgtacatcttctcaatccccatgatctcaatgagggtgatggtatcagttccattttatggatgcagaaactgaggtgatgcacgcagtcttgccccaagtgacaaatctcatccagcacagagctaggaggatggtgtaggtctttttctatcccacacacctctctggttaggcgtgaagcctggaggaacttggctctcctttgtgggttactgattttatgacagcactgagggggaaggcttattctgtatatggaggcagctttatacaacatgatctcctttcatcctctctaccttcctcttatcctcactttatatgtgaggagaaaggagagtcacagagttcaaataacaatgctcaagatcagagctgctcagtggcagacacagaattcagagcctgacttgaggctccatgtctgggactctctcccctgccccttcacagacgctgcttccggaagcccagagctactgagcatccgaggaaccaggtggtggctcccagagcagagaggccacaccaggttcaaaatccatccttggtctgactttttgagggttaaaaacacttcgtagaaatttccagtagaattattagtatatcttggtcacattttagataaaccatctttcagaatctcattgaggaggaagtaaactgaagagctctacagggccttatggatacagttgcagagtgtggggatccctggctcttgcctgccagccaaagatggacaaaaggcgttcctgagctttatctcatgggccgggatggagaggaggcagggaaatggccttgcccaggaggagaaccatatgcacgtggttctggaacatctgtcatagtggggaatgaaaatgtcaaagtaagcaaataattgaaaaagaaaaaaacactggcagggggtgattattccaagatgttaacattttgccctcaaacacaggttttagaaaattacaggcacctctctctcttctctctcttgctctgtcacagacacacacacacacacacacacacacacacacacacagagatac

SEQ ID NO: 443 - DNA, 2148 bp, Homo sapiens
atttttccctacctctcacatacacagtgggctggatgctggatgcaaagctccctcgtcacagccccaaagacaggacttgaccatctcagtgcaatgaccctgtggtgccttctcccgaggacctaagagccccctgagcgcttgcaaacactgcagacaaagcgagccctggcaccagctccctgcctgcctgttctgtgaagggagcctacaaaactggcagcccctgcagttctgagctgcagaactgatgagctggggcaccctgaaacctgactccaaaatagcagcaaacccaaggccaaaaggaagacaagcgagaatcccccaaaagccaaggtcatcatcaagccaggatgaggactggaggaggagctgacagctctgcctcaaatggatttgggagcgaaggctttttccataagctttgggggtaagtcacagagctaccccaaatgtaacttagtctcggggtctccttccttttcaccagctgtcccctttgctggaggaagctttccagcccaaacgaagggcttaagaggagtctggccattcctggcatccagttagacctggaggaggtgaacggaggagaagcctgagggaggggtgtgtatccggcctgggaattcctccctctcccttgctagcgccccaacccgccctcatcctgttcagagagggcacttacaggcctcggaggcaggggagggtctcctcctggggaaccatccccgtccagatggtgcccccaaccagctgcggcggcatgatctgggcggctggtccagggcatgggttgcggatcgtgtagggaagaggggaacagcagtcgagaccctactccaagtacgcatcaaagacgtcgagctccgagtcagcatcgtaaaggcccgagccggggtcggagagcacgccgaggtccacgagcgcctggtccatgtcctcgggcaggaagacgaggcccacgttgaggacgatgtactccatgaggaaggcgtagtacaggatcagcacattgacgaagaacaggcccacgtagaacatagagggcagcagcggcggcggcacgtaggggaccagggggcccagtgcgtccaggtgggccgcgacccgggcgccgagcatgcagcgggtggcaagggcggcggccaggcgatcccggcgaactcagccgctgcggcgcccgggcggccggcgagggcacagcgcagccatccaggggtaccctggagcccgacagaagcagggccgggctccagatgtcccctggcaattgcgccccgacccccgaaatgcgccgggcgggtcaccgcaccccgagatgtgcccccaaggatctctcgaccgcccgggcggcgaggcgggcccccctgaagtggcccgcggctgcccggctccctcgtggcgcctccctggcgctcgcagggcctcgcagagccggtggggatcccaccgcggctcagtgtctagggccggtcccggcagccttctctcccgccccgccccgcaggtcctcgcgcaccccccgcgcccccgcaggcccagcacccatggctgcggccgccgcgtagccctcccggtggcgctcggagctccgcctcccgaggggccccgagctcattggcaggccgccccctgcacgcgctaattggccggctcaacgcccgcgctgattggctccggccgccagggggcgggtaccgcttcgctccgcccctcggggccctagcgtctgagttgctttcctggttcgggtctgccctcagatctcaaatcgaattcgctctgcgtatcgaatagggggaggtaaaagagactgaacacagttcaaacctagacataatgctaaggccgcaaaagccgaaggaaacccgggctaccgctgcaccttgctgcatgcctctttgggactccgtttctcctttaaaaggaggcggggtcggggaggggcgacggacggttgccctggaaattttggacattcccaaagcgccaattttcatggtggagatccaccagtgtccccttcgcttctccaaactctggttgctggaaggtccgcccactacggaacctgcatcctagagttaaggaacacctgaataaagagattccgaggtagttcagatcttcaaccat

SEQ ID NO: 444 - DNA, 1740 bp, Homo sapiens
gtctctcagtctttctctctttctcattctctttcaatatggaacttgaaaagcgtgaaaaaagaagcttattaaacaagaatttagaggagaaactgacggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagtttttttggaatgctggtgctaaccacttgctagatttaactttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatag

SEQ ID NO: 445 - DNA, 2212 bp, Homo sapiens
atattggccgggtgcggtggctcacgcctgtaatcccagcactttgggaggccaaggcgggtagatcacttgaggttgggagttcgagaccatcctgaccaacagagaaaccctgtctctactaaaaatacaaaattagccaggcgtggtggcacatgccggtcatcctagctactcaggaggctgaggcaggagaatcgcttgaacccaggaggcgaggttgcagtgagccgaggtcatgccattgcactctagcctgggcaacaagagtgaaactccaactcaaaaaaaaaaaaaaggaaaaaaaagagacaatatcaatatcaacctaggaagtgctgggcattgtcttggctctgataatacatcagcaaacaagacagaaatgcctgcgtccttatgaacgtgttattttataagactctccagacctcatcccttccccagtgcagacttcgtgggaaccgaaggccccgtagctctcttcctgtgcagctgctgaaggcatttccagagcaacaggtcttccaggggcactcccagcttaaggggatgacgagacctcacatttgggaatcaggacctcattcaatcacgcagtcatttctcagtcagtggactcctgtgggccagcactgtgctgggagctaccctctcagaaagctccttgctgagcggagagaaagctgaactcacccataaagaccacaagcttcagcccagaatcagggtttccaatcctttcccctaatttgctttcttcctccctgctgtaaatcaggaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgaggtgggccgccatgctgtccccgcccagcatctccatctcacactcctcctggttcactgggtccggtaatactgctgcaggtccctgggtccctgtccctattccccaacagcccccttcagctcctgcatctgcccctgctgcctggccttcagcagtgttccatgtccaccgcattgacgactgcttgctggaagtgtctgagagctcgctggggctgagcagagacactttcctggtgttccaaccctgggggtctccaacacgttgaggcagcagctcagtgatctgagctggctacaaggaccaggatgcaccaagccaggacccccagtggaaggggagtgctgccaacagagaggtgcttctccccacatacacccaaggtcctggtgtgggcacaattaggctgagcctcaagctcacagtctttcggagtcctatgtgcactaatgagggtcttaggtgaacagacaccaggcaaggaaacggcttagaggacactgatgctgcataccggagcttagacctgggcgccagtccttccttacccaccacccccgagccccggtcccagggcctctttgctacctaagggaagaattcagcttcccctggaaggtctcctttgctgctcctgccaaaccactcctccctgggcaagaagcccctcgctgggcaggctcaggctgcagtggctacagggtactcccacctcccaatacggagagaggctgtattgcctggtgacagtggcatggactttggagccataatgcctgggttgaatttctacctgtgcccctcactggctgtgtgacattggatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacacaaag

SEQ ID NO: 446 - DNA, 1971 bp, Homo sapiens
aattttagctgggattatgctgtgattatgtttggcttaacagtaatgaaaataagtttaggctgggtgcggtggctcatgcctgtaatcccagcactttaggaggctgaggcaagcggatcacctgaggtcaggggttcgagacaagcctgaccaagatggagaaaccccgtctctaccaaaaatacaaaattagccgggtgtggtggcgtctgcctgtaatcccagctactcgggaagcggaggacaatcgcttgaacccagaaggcagaggttgtggtgagccgagatctcgccattgcactccagcctggacaacaacagcgaaacttcatctcaaaacaataataagtttacaacctctgaatatgtaccaaatggagccaggggtggggagtattaggacaagccccgcactgcagagccccccagctctcactcgtggaccaagtgcatgggacacagccattcggaaagctctttcttttggagtgggactgggtgttctggttttggtttgcttgttttatcattttgtgacattggcgcctattcttcagtttgcatccctgccttgcttgcttgaagctggagcacaaatgtcccgtcaccctgtaacaacacaagtatgcatcatgcctgcgaggcttagcttgggaagtggaatctccaggaatctccttcggttgtctgtctgccactttacactgttgctcccatttcggtcactgaggccctgtcccttatcctccagggacatggtgctgtcctatgagctctggctcctttgtgacttttacattgctcctccagatagcagtggcagtggcatttgcaaaaaggctatttgagaacaaataagaaaaaatcttcaaagcgaagatgatagtaaaacagccctcatttttcaaagtccattcttttttctggtccgtgcactgccagctcacttctctggctaaaacccgggggcggcgggggtgtgtgtgggggttagttttgcaaaaagtactgatggcaccgctgtgctccaagttaaccagaacacaagaatcgaaaaagcctgtgagatactggtgctcgtgatcgtaagctccaggtcggggggttttcagatgaacacaaaaagggggctgctcccgtcccaagatgagtgataaatgagtcacttctcatactcgcactcacactcgctccatttcctctgggatgactgtcttccgtcctaccgctgtggctgctgttatttgcctgataaacttctttccctctccctccctctgacacagaaacacacacacacacacacacacagacacacacacacacacacagcccgctggatctataagcagtttgtaacaggatgcaccagttctaatcacgtttcaagtcaaatgaaccagtcgcagcttcctaataagtgaatggctgacataaggagttaattcagaagcagctcaatactatggacaatactagtggacaatattagcatactgctcgtacaacaaagataccgtagtctctggtgctgcctcttcaggacgaatttgctgaaagtgagttgtaattagagatgttaaaaaaaaacattggctgcgcgcgatggcttactcctgtaatcccagcacttttggaggcgaggcaggtggatgacctgaggttaggagttcgagaccagcctggctaacatggcaaaaccccatctctactaaaaatacaaaaaattagccaggcatcgtggtgggcacctgtaatctcagctacttgggaggctgaggccgaagaatttcttgaacctgggaggtggaggttgcagtgacccgagatcatgccattgcactccagcctgggcaacaagagtgaaattgtgtctcaaataataataataataataataaactgagatttatcattcctcctctctccttttccttgagaacttaataaaaatggaaaatatccatt

SEQ ID NO: 447 - DNA, 2356 bp, Homo sapiens
gtcccgcgtcgcccccgcgcagggcgggccccgcacgcttatcctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagtgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaactgaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttct

SEQ ID NO: 448 - DNA, 1640 bp, Homo sapiens
aaaggggcagggagagcccctcgatgacagacaccccctctgtgccaggctggtggagaagcccagcagagggtctgaggagcacctcaagtctggcccgggacccatcgtcacccgcacagcctcaggacctgcccttgccttctggcaggcagtgctggctggggacgtgggctgtgtctcccgcatcctcgcggactccagtactggcctggctcctgattccgtctttgataccagcgacccagagcgatggagggatttccgcttcaacatccgtgctctgagactctggtctctgacatacgaagaggagctgaccaccccactgcatgtggcagccagccgtggccacacggaagtcctgcggctgctgctgaggcggcgagcaaggccagacagtgcccctgggggccgcaccgccctgcacgaggcctgtgctgcaggccacactgcctgtgttcatgtgctgctggtggcaggagccgaccccaacatcgctgaccaggatgggaaacgccccctgcatctctgccgggggcctggcacccttgagtgtgcggagctgctcctcaggtttggagcgagagtggatggtcggtccgaggaagaagaggagacccctttgcatgtggccgcccggcttggccatgtggagctggcagatctgcttctaagacggggggcatgtcctgatgcccgcaatgccgaaggctggaccccactgctggctgcctgtgacgtccgctgccagtccatcaccgatgccgaggccaccaccgcccgctgcctgcagctgtgcagcttgctgctttcagctggagcagacgctgatgctgcggaccaggacaagcagcgacccctgcacctggcctgccgccgtggccatgcagctgtcgtggagctgctcctgtcctgtggtgtcagcgccaacaccatggactatgggggacacacgcccctgcactgtgctctgcagggcccagctgcagccctggcccagagccccgagcacgtggttcgggctctgctcaaccatggcgccgtccgtgtctggccaggggccctccccaaggtgctggagcgctggagcacgtgccctcggaccatcgaggtcctgatgaacacctacagtgttgtgcagcttcccgaggaggccgtcggcctggtgactcctgaaactctgcagaaacatcagcgtttctactcctccctcttcgccttggtgaggcagcccaggtcgctgcagcatttgagccgctgtgcgctccgctcccacctggagggcagcctgccccaagcgctgccccgcctccccctgccaccgcgcctgctccgctacctgcagctggattttgagggcgtgctctactagatgtccatggccttttgagagggcctgaaagcagatgccccagcctgcagagggcgcgcctctgcactaactcaggccaggtagccctggcagcaggaggcccagctccgcaggcaggtgtggatgctgcaattcccaatgcagagaagcggaccgacagcggcagccgggtgatgtctgatgaagacacactcctactggggctctcctgaggcccccttctagcctgtgcaaaccctgtatgtgcattaaaaatctccaggtc

SEQ ID NO: 449 - DNA, 1663 bp, Homo sapiens
ctgtggcccatggacgctgagctggaggaggccgagtgcttctctgttgcgcttgcccctcacctagccttctgcaggaggcagccatgctggggccgctaacacaggtatgcgggctgctgggagcctgagagcactgtctgagctgtctcactgcatgtccaccaattgggtgaccatggggcattggcccagagccaccctgtcacgggtgggaaagctgaggcccagcacagggaatggccttgcctgagtgacattgggaatgggtggcagggcaggagctaactttgtccccaggctgtcagagctgaccccttgccctgactccgatggtgaaactgagccactctgccagcagtgtggctctaggtcagaggtagaggctttgtggggatagccccgggctcctcagcagaagacagcgtgcaatccctgcgtggtggagggaggtgcacacacctgcagacccctgccccattctatcccctgctctggggccagggcccctcccctgagtcctggagcctgatgaggatagagaggggaggcttcctcgaggagatgattcacgcaggcttgatgtgaagagagagcaaagccctgcagagaggctgggggccccagatatagaaatgtgggggagatcaaaggctttgagtggggagtgggccacactggatgggaaacaccttgcaggccaggacccaggagtcagggcagctccagggggcgccttttcatgacctcgtgtggatgcgcgtgtctgcgtggcaggggggatgtggtggggtgagagcaacttggaaggcctgcgtggatcagactgtccaaggggctgtgttgtgtggggagtcctgagtgtgtgtgagagtgagtgtgtgtggatgggggctgctggcagtgtgtgggagagagtgcatgttaggggtgagtgtgtcgcaggagtctgttgcatcctcctttcattctctcagcatttactgagcaccgactgtgtgtcaggctctgttctaggtgctgggaacactgcagtggagaaggcagtggaaacctctgccctttgtgtagaactcacacaaaccagacaaatcctgacagtggagtatcgaatggtgctaaaggcagagaaggactgaaagcagggagggctgtggtgtgtgtgtgcatgtgtgtgtgtaagccgggaggtgggtgacatgttaaataatgaggtcaaggattatctgggcaggaaatagttgagcaaagatttaaaggagagaagataatatttagaatatataaagaacttctataactcaaaaaccaccccccaaacaacccaactaaaaaataggcaaaggacttgtatgtatacatttctctaaagaggatgtgcaggctgggcgtggtggctcacgcctgtaatcccagcactttgggaggctgaggcgggtggatcacatgaggccaggagttcaagaccagcctggccaacatggtgaaaccccacctctacaaaaatacaagaattagcccagcatgatggccggtgcctgtaatccaagctactcggaaggctgaggccaaagaatcatttgaacccgggaggcggaggttgcagtgagctgagattgcgccactgcactccagcctgggcaacagagcgagactccatctc

SEQ ID NO: 450 - DNA, 2522 bp, Homo sapiens
acctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaactcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgattgttatggatcgacttaaatatctgaacctaaaaagagcagctattctaaccaaacttcagggtgcagaggaagaaattaatgacacaatggaaaatgatgagctatttcgtactcttgcatcttataaacttattgcaccaagatacagatggcaaagaagtaaatggggacgtacatgtcctgtgaatttaaaagatggtaacatttattcaggattaccagattattctgtgagttttctaggtaaaatctactgtctttcatcagaagaagcattaaaaccatttttgttgaacccacgtccctatctgcttccacctatgccaggaccaccatgtaaagtattcatacttggacctcaatattcagggaaaacaacactttgcaatatgcttgcagaaaattacaaaggaaaggtgactaactaactatctgtctatctatctatctatctatctatctatctatctatctatgtctatctgtcatgtatctatactcgattataatttgtaggattttatttgtactcagtttttaaaatttcatgttttaattgaataattgttccactgggcttggggtagggtaggcattctttttgttgtttattgctgcttccagaccagagtccctccctgcttcccaaaagctcccacatgtgaatatcgtgtcattcagactctgccacctattagctttcttggttctactcatcttctgtcccctgggtttcacttctcctggctcactctcactctccccatataatcactcctgtcctaattcttggtgatttcagtattacaaagatgatcctcccaacaccttgacacctccctcagtaatcttgttctccactctcagtaaatgaaattatttttagcttagacaagagtgatagcagtaaaagtggtatgaaacaagcatatttgggatataatttgaagacaaagctgaaagatttgatgagggattggaatgtggaggaattctagaaggggcaatgtggcttgaggattgcctatgcaagaaggaatggcacaagatcatggctaaagacagagcaattcaggccacagaaaggtgttagaagttgttcaaagtgctgttgcattcttttaagcgccggagtatcattttctatttgcttttaactttttcattgtgaaacatgacaaacatacagaaaagtgaagcccactgagttaccgcaaaatgaacccccatgtaaccaccaaccaggtcaaatctggaatgttgccagcacccagacgccctctcatgtttcttctcaataccagtctcctcactctccacacaaaggtaaccactgcccagaattttatggcattcacttccatacttctcctatggttttgccgtggaagcatacatccaaataccataggctagttttgcatggtttttttgaattttatagacctaaacaatttatcttctttgtgcctggcttctttcacttaacattataattatgatatttgtccagactattgaatgtagctgtagtttattcatttttattgttttattgtattctgttgattgacttataccataatgtatttatccacatttgagcactaataaaacttggattgattcc

SEQ ID NO: 451 - DNA, 2067 bp, Homo sapiens
aaaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaacagagtgttagtctgtgtctacagcccttcctctgcatgtggccacaggggacctttttttgtttctcctgacatccagacttggaaatatctaactacttgc

SEQ ID NO: 452 - DNA, 2613 bp, Homo sapiens
agagacctcggagaccgcgccggggagacggaggtgctgtgggttggggggacctgtggctgctcgtaccgccccccaccctcctcttctgcactgccgtcctccggaagaccttttcccctgctctgtttccttcaccgagtctgtgtatcgccccggacctggccgggaggaggcttggccggcgggagatgctctaggggcggcgcgggaggagcggccggcgggacggagggctgaagaacaacatgaaaaatacaggcccagtcaggaccaggggctccctgcttcccggtgcttgcgctgctgtgaccctggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgcagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcaccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagc

SEQ ID NO: 453 - DNA, 2350 bp, Homo sapiens
ctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttatgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccaccc

SEQ ID NO: 454 - DNA, 2585 bp, Homo sapiens
aacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgcgtggtgtgtgaggtccctcttgctctacagctgcagccacaggcaagcctccacttgaaggagaaggtaatttgccgggcctgtggtacaggaaatcctgctcacctgagatactgtgtcacctgtgagggggccctaccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctcacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgagtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactctgggaggctgaggctggcgtatcacctgaggtcgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctc

SEQ ID NO: 455 - DNA, 2973 bp, Homo sapiens
agaggggtgaccagagagcccaacgcctggtgctcaagactttctccgagctatgaaacccacgtagtcgaacaccgtgatgcttctcctgcagggcgtgtgatgaggaggcgagcttggctttggagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgatgaatctctgaacatcatcataaatgttaagattctgtgtcaccagttgctggtccaggtttgtgacctgctcaggctaaaggactgccacctctttggactcagtgttatacaaaataatgaacatgtgtatatggagttgtcacaaaagctttacaaatattgtccaaaagaatggaagaaagaggccagcaaggtacgacaatacgaagtcacttggggtatcgaccaatttgggcctcctatgatcatccacttccgtgtgcagtactatgtggaaaatggcagattgatcagtgacagagcagcaagatactattattactggcacctgagaaaacaagttcttcattctcagtgtgtgctccgagaggaggcctacttcctgctggcagcctttgccctgcaggctgatcttgggaacttcaaaaggaataagcactatggaaaatacttcgagccagaggcttacttcccatcttgggttgtttccaagagggggaaggactacatcctgaagcacattccaaacatgcacaaagatcagtttgcactaacagcttccgaagctcatcttaaatatatcaaagaggctgtccgactggatgacgtcgctgttcattactacagattgtataaggataaaagggaaattgaagcatcgctgactcttggattgaccatgaggggaatacagatttttcagaatttagatgaagagaaacaattactttatgatttcccctggacaaatgttggaaaattggtgtttgtgggtaagaaatttgagattttgccagatggcttgccttctgcccggaagctcatatactacacggggtgccccatgcgctccagacacctcctgcaacttctgagcaacagccaccgcctctatatgaatctgcagcctgtcctgcgccatatccggaagctggaggaaaacgaagagaagaagcagtaccgggaatcttacatcagtgacaacctggacctcgacatggaccagctggaaaaacggtcgcgggccagcgggagcagtgcgggcagcatgaaacacaagcgcctgtcccgtcattccaccgccagccacagcagttcccacacctcgggcattgaggcagacaccaagccccgggacacggggccagaagacagctactccagcagtgccatccaccgcaagctgaaaacctgcagctcaatgaccagtcatggcagctcccacacctcaggggtggagagtggcggcaaagaccggctggaagaggacttacaggacgatgaaatagagatgttggttgatgacccccgggatctggagcagatgaatgaagagtctctggaagtcagcccagacatgtgcatctacatcacagaggacatgctcatgtcgcggaagctgaatggacactctgggttgattgtgaaagaaattgggtcttccacctcgagctcttcagaaacagttgttaagcttcgtggccagagtactgattctcttccacagactatatgtcggaaaccaaagacctccactgatcgacacagcttgagcctcgatgacatcagactttaccagaaagacttcctgcgcattgcaggtctgtgtcaggacactgctcagagttacacctttggatgtggccatgaactggatgaggaaggcctctattgcaacagttgcttggcccagcagtgcatcaacatccaagatgcttttccagtcaaaagaaccagcaaatacttttctctggatctcactcatgatgaagttccagagtttgttgtgtaaagtccgtctgtgtgcagctgtacaggcagcttactgtttgctagaggatgcgaaagtcataagttctttacatattacttgtgccatatcttcttcaccctaaacatagctctttctttataatatttgtgatgatggaaacaaaagccttggaacaattgcactttaagtattacacagaagtaaaagaactacagaaaatgtacagcaagacaagtgcccggaagttcactgatccttcagaaggaaatgcgctttactgattgcaaagccttcagaatattggagtgtggtgtgtttgctcatctgatgctttttagttcagttacatgtaacatcacatttttttatcacgtgaaagatgttagatttgtttgcttataaattttttaccactcccacataaaatgctcatagtttgggagaggaaagagggaagattctctcttcttttaacagagagatgattgctctgtatacccattgcttcctccctgaggctgtcccaaagtgaacactgatggagtggtcaaaatcataaggttgtagcaagccaaagatacgtatgtgacagaagcacataagcaataagcagaaaaccagaagtgcatgctgtgatgcctgtgactccttcatcccgctcagtgccatgtcctcttttgtgatcttccagaaagctccaggattcatttgagttccacatccaagtaacagatgaattatattcatgttgtaatgcattttgtggagtttacaaaaccagtgtctgttaaaactttggaaaatgtcttagaaaatgttggtgcttggtgatgctttatttgtttaattatcaagaacaaattatggcaatgctagtttctgcttaaccaaaatactctgtgtatatattatacatatataaatac

SEQ ID NO: 456 - DNA, 2424 bp, Homo sapiens
acaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcatagagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacg

SEQ ID NO: 457 - DNA, 2386 bp, Homo sapiens
aaaaaaaaaggcgagaatgtgtggcgtagctaatattctgtcttcaaactcagtaggaagtcaacaaagaaaaatcccgctgaaagcgccaaggccggctgggttccccgcacctcctgcagtcctgcaggtacaactgatgcaccctgtagccccgctgtccctccaggatgtcccggtgggatgggagccggcgccaccccgacctgtgttccagccacccgcctgcagcccgggccccagttccggggcctgtaccgatcatatcctcctcccggttctcaaagctgatcctggtgttgtacttctccatcagagtcgaggactccagggtgtccctcacctttgtgtcgccctgcagggcaaagcccccttcagccgtgcagacactctgaacgggagcctgtcagctttgaggggacgtgggctgtgcaggttcctcccagcccggggctacctcctcggtcctggacaccatctgcactctgtcagccagcatgtctgtcattttcttctcaacggacttgaagctgcagaaggcaatagggacacagcagtgaggggcacaggcccgagagccatggtgggccacccaggagcccagtcccgagttgggtgctgtgccagaatcagggactcagaagctcagctccaggttctcctccgtgttcctctgggccaggaagcggctagtgatgtcctggccagtccgggggagagagaagcagagtgcctcagaccccagcccagctcagccaccctcctgccatgctccgggagtgccagggagcattacccaggcgtgagaggctcagccaccctcctgccattctctgggagcgccaggggcattacccagacgtgagagcaccgtacagcactcttgaccttctccaccacagcagtcacgcccgactggtattccatttctgctgtggaggtctcttttctcctcactggcagagcagaggggaggggcagtcagcatgcagggatggctcaggggctctgtgtaaggctgtcagacacctctgtacctgcccagctgctggggcggccacccaagacacaggcatccttcagagatgcctgcccccgccccaacctgctccctcctcagcccagccctgcagggacgccccaggcagccccagagcagaggtggacccggagtgagtggcgcagcactgtgagcactgtgggcccggtggtgcttctcagaggcagcttaggggtcaggatgctcatcctctgcagagtcactggggactgggcccttggtgcagggcccttgggtgctggggccagcatctctgaggccacatttggctacaggctctcagcctctggagggagaggcagggacctgtccttcccttcaccctggcggccacatgtcacacctggcctcagggtgacttgatccgttggcctgaatcagtgccagcctctccttgggaccctggctgggggcaggtggggagctgagcgcttacatttcagggtctccgtgctcatcaggttcgaggggaagtccaagtccatctggccctgatgggaggtgggggcggggaagggatgagacatccttggcagggagtgggccctgagtggtggccctgagcctgtgtccacccagctgtcatggggatgggcagccagccaggccctggcctggggcttacccggcggtacttctcgctggtctccttcgtgtggatcttgtcgatcagcttcttctgctggttgagccggttctcccttgcccggcgctcctcgatgaaggacgcctccctttgcctcatgttcctctggggacatgcgggtgggcacagggttggggagctgtctcaacaaggcccctaatggcagtaaagccagcgggcggttggccatgctcaccttactagactttggaactgcatccccggccaatggccacacccttttcctaaaccacttgtgcccgtggcccctcagctcacggccctccttgcccatgcctcagagcatgtgccagcccagacgctctgctgccctccagccgctggcccccagctgcctcctggccaggtccacctagaactcacggaagtgcattcagcctgcctgaagacagattcatcctcttccccaaaacctggcctcttccagcgtgcccttgggcagctaaaaccgtcatctgctaacccctgctcacgcaccccagacactgctctcaccctcgccactctcgttgccagcgcttagtggggttgcctcttgaggagttctcagctccgttgctcctggccaccccttctccaccccgggtatacccaggtgatcagcgcttctgccctggcaccttccagtccctgcagcctgagtacaccctttctgaagc

SEQ ID NO: 458 - DNA, 2292 bp, Homo sapiens
gggtatgtcacctaggtatcaaatggggtaagaaaagaatggatggaagagaggtgattcaaaattcaggtgtttggacactttgtgaatcttcccgttgttcttgacacatttttaaaatttcattttgattcagatcattggggatgaagttctcctgaattgtggcattttgttccctttgggaagaaggggctgaatttggcatgattgtacttgactatgctgtaggggaaaccagatctagtatagggacatcaatacttggttattggttcatttgcttatgtttgtatgtcatttgagagtgtgtattgacatgcacaattgaagggatgtagaaatgaacatgccctctccatttctttgaaagaagtcaaggctgaatcaagcaggactgctgttctgaaagaatactcagactatggggtgccttgttttccttcttttgcacctgtctttcggttggcttcaaaaaatcatggcttttgctgtgtttcttttttcctttgtgtcttccttttgagggaggtggaaaattgagaaaggagattgttgttttatgggtgggtgggtttgaatgcatctttcgcggtcaaatatttttctatgccttatgagcttagaaaataaatttggaaagtttgataaacacagaaattttttattttgtgttattttgtgagatgagggcttgccatgttgtccaggctgtcctggaactcctgggctcgggctgtcctcctgctttcagcctcccaggtggctggaactgcgggtgcatatgacggcacctactgagaaatttttgctatcaacctgaaatttaataagtcctggtcacaagtgaggaatttttagtttgttatttggattatttttgtgtcagggtggcttgatcacctatcgataatgcttgtaggaaaatggatatctcatctgttgctgttggaggggagtctgtctctttccccagttcttgcttcggtgaggtttccttgacccagagtctggtcctcatattttagattcggctttgggaattttgttcaggaactgcatcatacaacccaaaggcaagggaggaagatgcataagccaggatacctaaatgttcatttatttaaacttgagaatgtgactgcagaaggagtcaagaagtttggtactcaacacatttcttctttgtagaaataactgctcaagaagatggattgttacctaacagttgattgatgaatatgaggtcagagcaagaggggctgattggagattttactagctagggctgtttgcccaggccgtctgtccagactgtagacatggaatcaccggatggctgggatcctggtgcagctggttcccctttttccttaccctgaatgtcattaaggatgcattgccaggtgctgcccctctggcctgatgactacactccatgttggtcgcctgccttctttttcctgcggtcttcctccagacaggcacgccatgcagccgactacacttgggctcgctgaatgggtcgcattcttctgctgtgcctcccagagatttcatcaaggcacccgcagtggccttctggaggctcctcgagctctccactcaatgtttcctgggagtgtcgtgtttctcacctctagattgttgttctcgtcagttgcatgtgggtttcacaagcttatttctcagaatgcaggtctgtctcttgtatcctcgggaggcacacctttgtatcccagttagtactgacagaaattagactagggactggccaaaaacggtgcctttcctcactttgatctcactaaagtggataggactcaagttgttttgttcttgcaatggcattgacagatgtttgcaccaaaaaccatgttgaagttcattaaggaaactgtgatccaggatccaaggtcaaaagaacaggttcatcagttcagcacaccaccaactcacaggctgggcatcttgctgctgattcattgatgctgccatttgtcaagtgccaaattgaattgttgatttgtcgatgatttccttccgttggttacttatatagtgtattgcaattcttgttgctgaggtcagctacactttttctgtttgaggggcaatttcttgcatttgggatttcaggtgtggtgattgttgcaagtgtgggggacttgagttaacagcaagttttcaggtgggactttgcttgtgtgtaactgaatgagttcttggggacgtttgctggcagttttccacaaactagaaatttgtagaacggtgaatagagtagacttt

SEQ ID NO: 459 - DNA, 2320 bp, Homo sapiens
atactgcttgcctccaaatccttgtctcaggcctgcatgtggagagataaaacccagacaaagaggcagacatgagcagatgagctcccccgaacaggagacaagtgggctgagaggtgaaggaagaggatgagctccagcagcctaagggctatcctctgaagcagagtcacagagccgagtgtagcaagaaaaggctcggtgatgcctggggaggcgacgccggcagtcagaagaatccaaaggagccttgacagcgtcactgcagacaaacctgtctccactgactgccctactcagactctgcctgtctgtggtggcccactctcctcggggtggatcggcctaagagtttcattaaaatcaaggggacggggattgtgggtagtgttgggacccagtaaagccctgggcttaatggatcagaaccaaaaccccagctccacatgggcagccctcagttttcatgggtcagccctttctgagaaacccagccagggaggagcacaggaccagcagcaggggatgcttctaaacccatatctcactggataagctcatcaccttccaagcctctgaagaacatttacgttcctataagtttctgaagccacgttcaaatcgtagctctaccaccaatgagctgcacgttggaggggaagtgaattcaccccagacctgagttccacatccctagactgggtgagagggcctctgcccaggctctccatgaggatgacctgcaccgtgtgcctttaatgcacttagaacagcaggtgcctcagtaaacgctcactgccattctgcgatcattattgcattcacttcctggggctgctgcaacaaagtaccacaccctgggggcgaaaacaacagaccctgaccgtgccgatgctggaagtctgagatcaaggtgtgggcagggctggttccttccgaggactgtgaggaagactgttccacgcctctctgcagctccgggtggtttgcaggcaacctttccattgctggctttgcagacacatcacccagtctctgccctcatgttcacatggcgctctccctgtgtgtgtgtgtctgcgtcccagcctcccctgtttataaggacatagtggcattacatgactactattactctgatagggcctcatcttaactaactacatctgcaaataacccattgccacataaggtagcattctgaagtactaggggctaggacatcaacataggaatttggggagcacataattcaacccatgataatgattatcgtgattattattaagaatatataaccactgtaggatgaaagcaaatactgtaaaatcctactcataggtttgcagggattaaatggcatcactggaaaattgtctgacacaaagaaggggttcaacaaatgttgttttacttcctcactgtcagcctaaatatagaaagtatttgctcatcggcccgacagacaagttttgacttctagttttataccagctttatgtatacatgcttatatgtcgtatgtgacattttgtacatataaacattagttctgccttctaatgctattttgaaatcacctttcccttgttaaagtgttcttttgaaattatataaaatagctgaatagtattttaaagccaaaatgctacaatttacttgccatgttttataatttgcttacattcagatggtgtaccatcttgtgttctgttatgaaatagcacaaccatgcataaatggccctgccatcctacccctagaactttatttaccatgaaatgcctccacgtactttcatttgcatgtcttgagaactgaaccgtagacccctcttccctgtcagtgttgaccatcgatatttcctcccacatgtggcttctgtttctgtctctgggcagatttattctaacctgccctcaaatctgtaagaagattgttcattccctagggctagtccaagtctcctggcctggtgcttacttcaaattcacctaaatctggcataaaagctttcaggacaaggtggatcaaactgcgcccttgtgtgagtactccctggacagaatgtctggttatcttcggtgtaagttatttcccatgactcacaaatagaaatcaggagaggagggaggtaggaggtgcaagcctctgcagctgtctggagagtcagcaaaagggagacagaatctttagttacttcacatgtgtgacaatacgcctatgttttgttttatgttgtttatttcttatgtaacattgttgagttatcaaatgaagtggtgtataaaaatgtcaaataaacaggttctctcccttt

SEQ ID NO: 460 - DNA, 2189 bp, Homo sapiens
agccgtggtggttatggctggcctgagcggcgcgcagatccccgacggggagttcaccgcggtcgtgtaccgcctcatccgcaatgcacgctacgccgaggcggtgcagctgctgggcggagaactgcagcggagccctaggagccgcgccggcctgtcgctgctaggctactgctactaccgcctgcaggagttcgcgctggcggccgagtgctatgagcagctgggccagctgcacccggaactggagcagtaccgcctgtaccaggcccaggccctatacaaggcctgcttttatgcggaggccacccgggtcgccttccttctcctggataaccccgcctaccacagccgggtcctccacctgcaagctgctatcaagtacagcgagggcgatctgccagggtccaggagcctggtagagcagctgccgagtagggaagggggagaggaaagtgggggcgagaatgagaccgatggccagatcaacctgggttgtttgctctacaacctggctttggcctattacagcagccgacagtatgcttcagcactgaagcatatcgctgagattattgagcgtggcatccgccagcaccctgagctaggtgtgggcatgaccactgagggcattgatgttcgcagtgttggcaacaccttagtcctccatcagactgctctggtggaagccttcaaccttaaggcagctatagaataccaactgagaaactatgaggcagctcaagaagccctcactgacatgccacccagggcagaggaagagttggaccctgtgaccctacacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgatttataagttcctcacaccctatctctatgacttcttggacgctgtgaccacttgccagacagctcctgaagaggctttcattaagcttgatgggctagcagggatgctgactgaggtcctccggaaacttaccatacaagtacaggaagcaagacacaatagagatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccagataagaaaatgtaccatctctgcattgtgaatttggtgataggaactctttattgtgccaaaggaaattatgactttggtatttctcgagttatcaaaagcttggaaccttacaacaaaaagctgggaacagacacctggtattatgccaaaagatgcttcctgtccttgttagaaaacatgtcaaaacacacaatcatgcttcgtgatagtgttattcaagaatgtgtccagtttctagaacactgtgaacttcatggcagaaacatacctgctgttattgaacaacccctggaagaagaaagaatgcatgttggaaagaatacagtcacatatgagtctaggcagttaaaagctttgatttatgagattataggatggaatatatagtaatagctgatagtggcatttatcaaatggctttgttatgtaaatttgcatcgctttatttaccctttggcatctttatatttgttacatgttgaactttgtacacttatgcattataaaaaaaaaagtagctaaaacttttgctgttaaatttcccagaaagtgacatattctaagaacttttaccccaggagttatgaaaaattccaaacttatgaggaatgtttatatcagaagttgtaatacgtttgtttccttt

SEQ ID NO: 461 - DNA, 2132 bp, Homo sapiens
aagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtccggtttttttcaggataaatgaatgattctgccttttgttatgtgcgtgaacagaatggaacaactcaagtagcttcatctccagagactgaatttattctgatagacctcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaatctcttcccaaatctaaatttgataggggaggtggagattccaggggtgggtgaaagaagagatagaacttagcaggcagactt

SEQ ID NO: 462 - DNA, 2247 bp, Homo sapiens
aagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctctccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcctgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagaatatgcacagtctaggccgggcacggtggctcacgcctgtaatcccagcactttgggaggccgaggcatgtggatcacctgaggtcaggagtttgagaccagcctagacaacatggtgaaaccttgtctctatgaaaaatacaaaatttgctgggagtggtggtgcatgcctgtaatcccagctacttggaaggctgaggcaggagaatgtcttgaacctaggaggtggaggttgcagtgagctgagattgcaccattgcactccagcctgtgcaacaagagtgaaactccatttcaag

SEQ ID NO: 463 - DNA, 3334 bp, Homo sapiens
gacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatactctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctccagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtggatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagtgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaaatagatgcaggctg

SEQ ID NO: 464 - DNA, 2055 bp, Homo sapiens
agttcctatccctttcggagctccagcctgcccctcctgacgctctcagagtctggccttctgctgggccccgcgtcctctccggacctgtggctgctgctgttgcgtagcgtcgactccttcgagaagcagtgagacgtggcggggtgggggagggtccccggggttggggagcgcgcggcttggcggagtagggggcacggccagcgcagtcagagctggcgccctcctgcgtaagcccaatccgggaaactcgttgcccctctcctgggaaaggaacgtccctccccagggttgcgagtgactcgggcaccatcaccctgtgctgtaaagacctgcgagtgctgcagctggaaatagagggcgcggaagcgacgctgggcatcgcccgctccatcgaggtgtgccgagggagctcccgagccctttaagctctccctgtctcgcgtagaggggaataaaaaggtgcttctgttcaaagaggctccgcagccgcagctaaatggcagggggatgcagggtggtccggggtacttggagaggccgaagctgaagctacaggactgaggggctggaaagggcgcgggcgagacaattccgaccctccccagagcccctgacttccttctccggacgctgtcctccctggaatcagtcatcacctccttccctttattctaccgtcccaagggcctgagattgggcgactcctggcacttcctcccgcccgaactctactgcaagagagtagctcgcgaagcttagtcccttctttgtcaagccaggacccgcccacggtctattcatagggtcccaaaccactttggccacaacacccccagactggtccgaagcctcgtgagttcgccctggtcgttgcactccagcctgtcgctgtgcagacctggcttagaggacccctaaggctgaggggtcacttccagaactgagtccggtccgcaggttctgctacgctccagccagcccctaactggtccccagaagcggcgctgctacagggaccaggagctgctgcgaactgcgctggcgggggctcgtccttgggcgcggggcttcatcatggacacgctctcggcccaggccgcgaaacaagcccgcgtgactggcggaggcacagagaccaagaccatggctggattccaggaactggtggagtggaagtggatccaggaaaccttctcccatgcccaccccaagcatgaggcacccacctttctcctcttcctggactgcgtgtggcagctgggctgccggttcccactgtcattggagtttggggaagggctactgttggcgctgtttgggcacgcctatgcctcctcttttggcaccttcctctgcaacagcgaaaaggagagagatgaagtctcgctctgtcacctgtcgcctggtctggagcgcagtggcacgatctgggctcgctgcagcctttgcctccctggttcgggctattctccggcctcagcctcccgagtggctgggattgcgggagtgtgccaccacgtccggctaatttttgtacttttggtatggatggagtttcgccatgttggccagtctgatctcgggctcctgacctcagatgccgtgtgaagggaggactcagatgcactccctgtggtctgggctcaaccagccaaaagagcaacaaagactccagaacccactctacctcctcaatcccttggccatctgtggagccccagagcctgcggctgtggcaaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggcctcaataataaaagtctccatgatcagc

SEQ ID NO: 465 - DNA, 2067 bp, Homo sapiens
gttcattccaagcggaagtgatggctggtggatatgacttgaggggaattcctgagggcaaggaaaaggaagaaaggggccccagagaagacgaggcacagctggagaaccctagggctgtgaacactgcgactgccgcgcggggcagctgcgccgtgtttgctggaagcctccggtagctgctgaaaccttcgctccggaggtcgcctcggtaaaccttgcggatgattccaccacggcggaaagacgaaaaggaggcttctaggcacccgggaccgcccgtgtcccgcccttttccccgatgaagtctgacgcggcaggtccctcggcagggttaatgggacggcctggtggggcattgccggtctttcccagccacagacaagcttcgcgcctcgatcccccagcgcccccagacgctggatgccgaggcctggtcctttacagccgccgacgcctcatgagcgaagccagccagatgccagcaccgccttcggccccgccccgagccagcccctcccacatccccgcccggggcacgccctcggcccgcccccatctccgccccgagcacgcccctagattggccccgccccgtccccgcccgcaactccgccccgaccggaagaagccgcggcacccagcgcttatagggccgggaatgggggtgccgccgctgcctagtcagttctgcgtccgctgaggctcggtcaccgcctcgctgtcgtcgcggcgcccccgccccgtcctctgtccgtaccgcccccggagccagggccgagtcctcgccatgccggcccggcggctgctgctgctgctgacgctgctgctgcccggcctcggggtgagtgaccggggagcgtggggtggaggacagctcgcgacggccgggtcggggccggggcagcgtcgcggcgccggggctggagtccgagctgggagcgcgacggcggcggccagatgccccgtgagcccagccgtgggaggctcgggccgggcgtaggaggcggcaccgggccgggagagcttccctgacgggagtcgcggccccaccgaggcgtcggccgcccgaagagcctcccaagccagcgcggctgtcacgggcagcggctccccggaccccgcgggctcgggcgcaacttcgtggcgtcctgcacggcacttgggggtcccagaaggccccggcctgaggaggccgcccacctgcgggaccctcctcctcgcgggcgggcgccggcgctgcctggcgggggccgcggaggagccgaaagggcgttgggatccaggggaagggtctgtcctgcgcttcgaatccttgtttgaactttttaaaaattcgaaaactttggggaacgaatgcaacagggagtaaggactctcacccgagagctggcttctgccacttgccctgccggtttcttggtactgggaggctgcaggcttccttctgtgcaccgagacttccttgagcaagtggagctgtgggaattgcactcttggaagatcccgcatgggttcgaggtgaggccgcttcagaacctcaaatgaaagactgtctcctcgtgggagagcacctggggccatcagaaatgtcttttcatctttttctggaggagacgaatgatagggcctggtttacattcatttaactctttatgaccttcactcagctgtggatttgggggcactttgtgggagacttggcttttttttttcttctggttggaagaacctaaattagtgaatgtttttcacaaaatgtattgttcaggatgtgagcgtggcaaatttgtccgtgttctgtttaatgacctctttaaaggtactgtgtactctttaatagggatatcatgtaccaggtgtcccagtagagcactgacatgtgtgtgcctgagtgccagccaccgtgtgaactctttggaggttttgcattttaggtaaataactgtctgtactcttggagtaacaagaatttggaaacaggagaagtaaataaataaggttgcctttttcaaattcagggttttttttttaaataaaggaaaatttgtagactctttataatag

SEQ ID NO: 466 - DNA, 1948 bp, Homo sapiens
gcgcaccgctttctgtttttcctgagcctttgcctgctaagagggagaccaggtcaaggcagccatgcctctgaaagctcaataccaggactttccctcaagtccctacctgtcccctctgccccacactctggcccggagccagaggattggctctggggcagcaggaacctgttgttttaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcaagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggc

SEQ ID NO: 467 - DNA, 2020 bp, Homo sapiens
atttcactccctatccagagggcacagacccagggacaggcagctgacccccggcagtgggtcactatagatttgccagtggagacctccttgaccctcaagacttggatgaatgtgtggagtgtgtctatacaagtgtgcctggaaatgtgtgggtgaaagagaagtaattggattttctcacttgtaactactaatcccccgcctctttctaataattctccatggagctggcctaaacaccacgcaggggaaaacacaaggaccattttctttcaggaaagctctatttgccacaatccagatgaagtgcttaaagcatccccttaatgcaacagttctaattcctggctgtggatccaagcatgggcttccaatggggctttctacatgcaagattcacctatagttgtatgcacacttttatgtacacataaatatgtctatcattctggggaggacgttcatagctttcatgagataaccatgaacaatgacctaacagtcttaagaatcattaacttagtaagatacaaaacttcgttttctacaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgcgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccacattc

SEQ ID NO: 468 - DNA, 3288 bp, Homo sapiens
gcaaatacagtttaaaggaacccggacagggcatagtggctctcctctgtaatcccagcactttaggaggctgaggccaggagtttgagatcagcacgggcaacacagcaagacaattaagatttgacgcttacatttttctcctcaagggtggggaaaatagtccctaacctcacgaactgaagcatgcaggggccaccacccaagggcttttgcaaaggttaggttttctgttagggtcttgggaaatctttaagaatgtcaattccttgggaatagcttattttaagggatttggacatggagaggtctgtttgggatggtttgctcttgtaaagtctttggggatatttgtcatcatggcatctttgatgggcttttctggaggttgttattgcagggtttctggtactgactactattgtagtgccttggagatgttgaatttgtcatcatatcctatttgggtaagtctatttagaggttctccaagaagggcagcttcctgtcaatatcctctttccctacagcatccctcttcatcgagtccaacctggacgcaggaccctgaacctactgaggggatggagagaaccagcagagctccccaagttgggggccccatcccctggggacaagcccatcttcgtacctctctcgaactacagggatgtgagtcacagccccacacagccctcacccctgcgcccttgagccaaactcttcgtttactctcctcttttgctatcaggtgcagtattttggggaaattgggctgggaacgcctccacaaaacttcactgttgcctttgacactggctcctccaatctctgggtcccgtccaggagatgccacttcttcagtgtgccctgctgtgagcttctatgtgggagaataaggctgaatgggggtgaagggaggaggcggggctggacctcagcttctcagaggcttttgaggaactgttcttttatcatgccctcacaggtcagaaagtcaaaggggcagtaggcactggggagattccctcccccatgacacctttctgacctctaacctagggttacaccaccgatttgatcccaaagcctctagctccttccaggccaatgggaccaagtttgccattcaatatggaactgggcgggtagatggaatcctgagcgaggacaagctgactgtgagtggcctttgactctcagaagtcttgagcctgggagaaccccattgtctaagatcatctggcttaggaagaggctcgaggaggagcttcccaagccaatggatggggcttttcaagtggggaggagggcctgcctttcagagtgaagggatggtgcgtcacaaggagggggaggggcttcctgggtgaagaggtagggcttctcaagcaggggggaggagcttccaaggttaagaggtggggcttctcaagcagggaggaggagcttccttggtgaagaggtggggcttctcaagcaggggaggagcttcctgggtgaagaggtggggcttctcaaggagaagaaaggggttcctgggtgaaggggtggggcttctcaagaggcatagtttcctaggaagttggggcttgcatccagaagtccccagacctaggattcatgccttggtttgggagacctcaggacatgtggttattgtcctcccaaaagtaactggtcacatctcaatctacccctagattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccccgcctactggcagatccacatggagcggtgagggacttggtctcctggctctggagctggaggctgggggcctggactcctaggaccctgcctctgatgactgcctccttccccctcagtgtgaaggtgggcccagggctgactctctgtgccaagggctgtgctgccatcctggatacgggcacgtccctcatcacaggacccactgaggagatccgggccctgcatgcagccattgggggaatccccttgctggctggggaggtgaggtcccagtctggtgggtacgggctgggaaggctgatggcagtttgacagtgaacatcaaagggcctgagggtgggaggcaagtatttaaggggctttccagggcagcaggcactggacttcgtgacagatagtctggagggtggtggaggaattgaggacactttccacgtgtctacactgcgactctgcggatggtggccgggtggagggagacgatcatgcaggtttgcttgggactgcgtaagtctaggcggcagggcctctgcacacaggacgctgagtacccaggtgctcaatagggaaattaccctatggcactggggagccacggaagggactgaacagagcaggaatctctcatcttcactagttcctcttctcccccagtacatcatcctgtgctcggaaatcccaaagctccccgcagtctccttccttcttgggggggtctggtttaacctcacggcccatgattacgtcatccaggtaggtggccatcaccatgacgccatagtgacgtcatatgacggtttgagagggtagagctgagagacgtcactaggaagggaaggggccacagaaacatttcttttccctgtgatggcagtttgttggcgaacatcaaagaacccgagggtgggggggatggacgggctcccaggcaaatggccgtccttgtggccgcgacacccagttgtcgtcttgttgccttgcagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttccattg

SEQ ID NO: 469 - DNA, 2441 bp, Homo sapiens
gtcacaggcgctgcgtgccctggctctgctcgccactggccggcgcgctcccggcgcacggagcacactcgcgctccgggactgaaacctgagcagccgtagcagccgaatttgggagcatatccttgtcactgcagccagaaagcccttcgatccccatcagagaggtcacatgagccccgaggtcacctgcccgcggaggggccacctgcctcgcttccacccgaggacctgggttgagcccgtggtggcctcgtcccaggtggctgcctccctctacgatgcggggctactcctcgtggtgaaggcgtcctacggaaccggaggctcctccaaccacagtgccagcccatcgccccggggggctctagaggaccaacagcagagagccatctccaatttctacattatctacaaccttgtggtgggcctgtcccccctgctgtccgcctacgggctgggatggctcagcgaccgctaccaccgaaagatctccatctgcatgtcgctgctgggcttcctgctctcccgcctcgggctgctgctcaaggtgctgctggactggccagtggaggtgctgtacggggcggcggcgctgaacgggctattcggcggcttctccgccttctggtccggggtcatggcgctgggatcgctgggctcctccgagggccgccgctctgtgcgcctcatcctcattgacctgatgctgggcttggcggggttctgcgggagcatggcttccgggcatctcttcaagcagatggctgggcactctgggcagggcctgatactgacggcctgcagcgtgagctgtgcctcgtttgccctgctctacagccttttggtgctaaaggtccctgagtcggtggccaaacccagccaggagctccccgccgtggataccgtgtctggcacggttggcacataccgcactctggatcctgatcagttggaccaacagtatgcagtggggcaccctccatctcctggaaaagcaaaaccccataaaaccaccattgccttactctttgtgggtgctatcatatatgacctggcggtggtgggcacagtggacgtgatccctctttttgtgctgagggagcctctcggttggaaccaagtgcaggtgggctatggtatggctgcagggtacaccatcttcatcaccagcttcctgggtgtcctggtcttctcccgctgctttcgggacaccaccatgatcatgattgggatggtctcctttgggtcaggagccctcctcttggcttttgtgaaagagacatacatgttctatattgctcgagccgccatgctgtttgctctcatccccgtcacaaccatccgatcagctatgtccaaactcataaagggctcctcttatggaaaggtgttcgtcatactgcagctgtccttggctctgaccggcgtggtgacatccaccttgtacaacaagatctaccagctcaccatggacatgtttgtgggctcctgctttgctctctcctcctttctctccttcctggccatcattccaattagcatcgtggcctataaacaagtcccattgtcaccatatggagacatcatagagaaatgaagatgcttacctgcaggaactgaaaacatcagccatggccaggcccccagaagacaaaagaagggaccagggaactggtgacctaagcaacccactgcttaagaaacctgcgttccagccagagttggcctcagaatgacctgctctggctcagggatccctggtggatggggaaaagcactttcctggtgatggaaaaacgttctcagctttaagacacccccattaggcagacactgggttctgtgacagcagagcatgaccttaagggttacaggcaggctgcacacagcagtcccaggccctgtgaggggcttcagactccagctacagcgagcctgccccttttcttcaagggactgtcttgagggctccaaagtatagctaactagtcacctgggtgctgtgctgaaagtcccatgggagaactcaaagcgtgcattatcacagcctgaggggaatgtggaagggatgttttgtaagaactaccaacagttttgcacgaacaatgtcttttaaattaaaataaaaccttgaaaaaagtcagctttctttcctgagtcttccttacctacaaacactcaggagggggatggagctcaggcccttgtcttctgggtagttttgttactactgttgcttttaagaagcaaatgtcacaaggctttcttcaatgggatgttcaattgagtacttccagtcaacagtgcttcccaaagtgggtggtgtgaaggaagaggaggtacattaagagctattttatttgaggtagtcatttttataaccttgtttacttggatttataaaagcagactcacctaataaaatcaacattcattgt

SEQ ID NO: 470 - DNA, 1939 bp, Homo sapiens
atctgatgcccatcattgaccaggtgaatccagagctccatgacttcatgcagaggtacatatgtgtctgcatttctgtgtgcatgcatacacacgcccacacccccccacacctgaaacactcctcacaagccgagcgcagtttcctcattgtcttgggtggatttgttaagttctccccagttgttccagtcaccagcaatctgggtaattcagttcttggagcatttttggggactgtgctctttgggggacatagcccatcccttgagtttacatctagtggggagaggtggataaggtatgtatgccaaggtaagatgttgaggttattgccacaagagaaacacaaagtcctgtgggatccagtggcgagaaggggaaggccaacaatgggttgttttatttcccaagtaccaaagagaagaaatatttttttgcaaatcccatgtgatgttttgtttcttctctgtttagttggaaatgtgttcttggccaatgcctctttttttaaaattttttaaaaggtaatggctatgccttctttttttttgagatggagtattttctcttgttgcccaggctggagtgcaatggcatgatcttggctcactgcaacctctatcttccgggttcaagcgattcttctgcctcagcctcaagtagctgggattacaggcatgcgccaccacgctcggctaattttgtatttttagtagagacagggtttctccatgttggtcaggctggtctcgggctcccgatgtcaggtgatccgcccgctttggcctcccaaagtgctgagattataggcgtgactcaccgtgtctggcagctacatcttaagatatttcagttgtctcatgttaacagaaaaattaatgcagtcatgttttcaggcttgggaatatgtacctgtgccccccagaagggtaagacttagtcagaaggagaatcatggcgtagttctctgaaaacaactgcttctcgttcctgtagttgacatttgttggccagtaggcgagcacccagtgagataaagcagccaggaccctgttgtggtgttagtgttgtggtacaccttaaagactttgtattaaatattttgtaaggagaagatgctgaattcctaggtaactgaattttccagaaatcttattcctaaatgcttccttctcaccagcgctataaggcccagagagagggaagggatggcccacaggacctgacacctgcctttcctttgtttctagtgctgaggtagggaccatctttgccctcagctggctcatcacctggtttgggcatgtcctgtctgacttcaggcacgtcgtgcggttatatgacctcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtcc

SEQ ID NO: 471 - DNA, 2066 bp, Homo sapiens
taggtccaactccagggctaacttccagttgcaaccgctgctcccgcccgcgggaggtgcctcgcaccgccccccgaccccctccatcccctccacccactcacccactccctgtgggtccctgcagaagcggcccggcaggctctgcccaccggcccctcctggcctttccccatcccgcacacacctcagctccaggacactcttcccgggaggaactctgctcacaaagcccaaggaccagacagaacggcccttcctcccctcacccacctgaaccaccccagaaagccctgagcagaggccaggccacccagccctctgccatgtatgaaccacctggtcccacaccttccgggtgtcccaggccccctcacctcacacctcaacaccgcagctctaattattttaaaccccacatctttttcttttttttcttcttgatctttaaaagaatatcatgacaaaaaaaaccccacatcttaaattcagatactcacggccaggcacggtggctcacacccgtaatcccagcactttgggaggccaaggcgggcagatcagttgagcccaggagttcaagaccagcccgggcaacacagcaagaccctgtctctactaaaaataaaaaaaaattaaaaaacaaaaaacaaacaaacaaaaaaaccccaggtgcagtggtgcctgtggtccctagtactcaggaagctgaggcgagaggatggcttgagcccaggagttggaggctgcagtgagctacagttgcactgctgcactccagcctgggtgacagaatgagaactctgtctctaggggaaaaaaaaatcggaaactcgggctgagagagggcaggtcacctgccagaggcccgcaggtggggctggccctgctgcacctggagggtggttctctccgagccagcctttcaggtaggcactgtgactgtccccacagcacaggtgagaaagctgcatcacagagaacttgttaagtgacttgcccaaggccacacagcggccaggggtggaggtggaaatctgagtcgggcggtctggcttcaatgtcaacacgcatcaccgctgcacctggctgtcctagagatgactctcgaagacattgtgcagagagaggtgtggggcacggtggtggccagaggagccccagcccctcccgggcctgtccccacacgaggggccgcctcacgccgcctctctgtttctcccgccagcacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcccgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagct

SEQ ID NO: 472 - DNA, 1965 bp, Homo sapiens
aatccttgcgcttgtaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaagagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatcttggagttctttgagctgtgaagtgctgtgcatcgtgtgattctgtgtcccttttgtgcaggtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgcagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctaccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatat

SEQ ID NO: 473 - DNA, 1644 bp, Homo sapiens
atttgcaagcctctgcagaggcgctggagctgggtcagtccgccgctcaccccgcggccgcaccttcccgccttctcaggtaactaagtgcgggtctcgggcctggcagaagcttcttcggccccgtgccctcgcctggccccgccccgtcggttgtgtgcttgtctcgtcctgcccccaggccctgccggtccccaccgttaggccggcgtccctgcccggccccgctgcgggctggcgccagctcaggaggacgccccgaagccgaggcctcggaagcaggtttttcccagaccttctcctgtcccgcgttccccctaggccggccgtagggaccagaccccaccctaagcccatagccggccttcgcgctccgggtgaccctggctggccctgtttgtctgtgggtcctgggatgcgccactcccggcaggaaggggcgccgccgaggcccggtctcagcctggaaccccgctcctgccgtcggggcgctttctgcggctgcccacacacgaccccaggcaaggggtgggggcgcgggaccctccatgacatggcggcggggcgctctcacttctttgaaaccagcgtaaactggacccgccccacctcccataccttgggggagccccgggaaaggctgtggcctgggggtctgcagggcgttggcagtggaggtggggagagaccccagccctttcctgtcccccccaccagccttgccttcctcgccgtgagccggggacagtggaggggagtcagggagggcccaccagatggactttcttgtgactcatcctataaagcccctcgggcttagccaccctccccaggacccgtgtggtctcccggactgtgctggaagcttagagccagaatgacttttccaccctcgggctggctggctcagtgggcagcagggacagggggctgtgaagagaaaactcactcgccagggtcaggggccgcttgctcactgaggaaagcagaggggttcctgccgcttgcctcaggaacaaagctagttggtgaggcactgccttgcagttgtaggagaggaataatggcccccgtgggtgcttggttggaacgattaaaggagaataacagtttagcacgattatttcacacagttgttcaaagagatggctttgaattccagcttacatggcgtcttcaacaaaaagtaattgtttagagaagtgacaagatgaaggaggactctgagtcctagtctccctcctcgagtccctgtgtgagcagaggtaaacaatgaaaactcaccaaccaggagaaattcacctaggactggcgcagaaggtatacaccatgagcctggaaatgatttaaaaaacaacacaggctgggcgcggtggctcacacctataatcccagcactttgggaggcagaggcgggcggatcacttgaggtttgcgagttggaaaccagtctgaccaacgtggagaaaccccgtctttactaaaggtacaaaattagccgggtgtggtggcgcatgtctgtaatcccagctgctggggaggctgaggcaggagaatcccttgaacctgagagatggaggttgatgtgagctgagatcacacaattgcagtccatcctgggcagcaagagtgaaactccatctc

SEQ ID NO: 474 - DNA, 2278 bp, Homo sapiens
ttcctcattagtacagtccagaaaagtggaattcctggtctgggtggctatggtgccctagaccactggctagaccagggtggtgactgccagctggccgaatgtggggtctccagcctagcacccttggactctaccccaggagttatggctgtttcagggccaggggcctggcctcagcccctgtcccccttctcttctcctcaagttgcccagcatcaggtcccaaccagcatcttttgcagacagggtgggtcggctcctcactagaggggcagggttgggcgggaagcctgttgagccctccttcctgtgcagcccacagccctggggttagctccagaggggtgcagaaaggagcccccaaaggcagaaactcacccttctctctgttcttgtgcttccagggataaaggagaggtggtcctagctggggggctaccagtggcatgcaggaggcccacatgaccactgtttgctggggcctttccttctctgtgagagagacgagagagaggagagagagtgtgagtcagggtagtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagatctcttatcaaacttccaaaattcaattttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacgtgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccctcctctgtgtgagctgcggtcagcaggaaggctgacctcagaggcggccccagggcccttggaggccctgcccctgagacatgggccaaggtcagagagccgagaaggctgctgctgaggactctggttggcgcccagcccagcggcccttcaggcgggccctgtgcaggggctgatgaagtcagctgggaaatctgtgaaataaagcacaggtcccccaggcttgcccagagccccggcatcagatgaggtgcagagaagggaactgagctgccaagtgtgaacaggagagaggagccccaggaccacacaggggccccgacacggcaggtgcttggtcagcagcggtgctgcccttactgctggacgtgggaaaatgcactgacacttgctgaccagagccggggtgagcatctgggtgaccctgcagatgagacaaaataagggctgccgtgggggaggggcccttgccgggccaccctgctgaggccctgtgttactgtcctgcggctgtcataacaaaggaccacaagtgaggtgactcaaaacatccgaaatcggccacgtgcggtggctcgtgcctgtaatcccagcactttgggaggccgaggcggttggatcacgaggtcaggagatcgagaccatcctggctaacatggtgaaaccccgtctctactaaaaatac

SEQ ID NO: 475 - DNA, 1527 bp, Homo sapiens
ctagttggcggcggggtcgggtccgcgtgagccgcgatggagctgcgcatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgccctaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtg

SEQ ID NO: 476 - DNA, 2172 bp, Homo sapiens
catcaacttccggaaggaggcggaagagcttctcggctctaggctctggagtcccgggagcagtgaggggccacccggggcacaggaaagggccgctaggggagggccgggtgcactcggggtttctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcatcttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgtccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacaaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaaccttcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcctgctgcccctagtccggggcagcctaggaggcccaccctctttggagtcctgctgtctgggtgccagggccggaacgaggtagtggccatctcatacctactctgaaatgcaaaacttctattctgttgagtgaaagaataaaatgtagacaaaatct

SEQ ID NO: 477 - DNA, 2566 bp, Homo sapiens
gtgagcgcggccgccggccaggatcgagccctggcccgggccctggcccagccccggcctccaaggaccgcgccgaaggaggtgcccactggagggaggaggcgctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctgattgggagtatgtatttaaaaacagtgaattttcatcaaagcaagagacatatgaagaatcatccaaagttgtgacagtgggagcaagacatcttagttatagccttgactatcccagtttgagagaagactgtcaaagtgaggactggtataagaaccagctgggaagtcaagaggtacatcttagtcaattaatcatcactcataaagaaatccttccagaagttcaaaataaagaatataacaaatcttggcaaacattccaccaggatacaatctttgatatacaacagagttttcccaccaaagaaaaagcacataagcatgaaccacaaaagaaaagttaccgaaaaaaatctgttgaaatgaaacataggaaagtctatgtagaaaagaaacttttgaaatgtaatgattgtgagaaagtcttcaaccagagctcatcccttactcttcatcagagaattcatactggagagaaaccctatgcatgtgttgaatgtgggaaaacgttcagccagagtgcaaacttggcgcaacataagagaatacatactggagagaaaccctatgaatgtaaagaatgtaggaaagccttcagccagaatgcacacctggcccaacatcagagagttcatactggagagaaaccttatcagtgtaaagaatgtaaaaaagccttcagccagattgcacacctgactcagcatcagagagttcatactggagagagacctttcgaatgtattgaatgtggaaaggcctttagtaatggttcatttcttgctcagcatcagagaattcatacaggagagaaaccttatgtgtgtaatgtgtgtgggaaagcctttagccatcgtggatacctaattgtacatcagagaattcatactggagagagaccctacgaatgtaaggaatgtaggaaagccttcagccagtatgcacaccttgctcaacatcagagagttcatactggagaaaaaccttatgaatgtaaagtatgtaggaaagccttcagccaaattgcataccttgatcaacatcagagggttcatactggagagaaaccctatgaatgtattgaatgtgggaaggcctttagcaatagttcatcacttgcacaacatcagagaagtcatactggagaaaaaccctatatgtgtaaggaatgtaggaaaacatttagccagaatgcaggccttgctcaacatcagagaattcatactggagagaaaccttatgaatgtaatgtttgtgggaaagcgtttagctatagtggatctcttactctacatcagagaattcatactggagaaagaccctatgaatgtaaagattgcaggaaatctttcaggcagcgtgcacatcttgctcatcatgagagaattcatactatggagtcattcttgactctttcctctccctcaccccccacatcaaatcagttgccaagacctgtaggtttcatctcctgaatatttctggaatccacctcttgaatccatttccatcccatcatccttgtccaatgcacattaatatatttgacatgggatactcgagtagctttctaattggtctccttgtactcaccattgtctctgtcagatgtccacattgcaaccaaatttgtatttttaaaaatatgtttaatctcatttctccctcattaaaatccctcagtggcatcccatggtttttaagttaaagcacacattcttcaaaatagcctaaaaacctagcctctaacaccttgttccaggttaccttccacagtttctatcttgtgtcactatccatctcattctctgaatacttatccaggattaagatacatattccaggatcaaaaagacctgggttccaatctttgcacttccatttcctgccctctaatttgggggcagcagtttgtgctttgtaagcttcagtcttatttatagtgtgggaataataatggttctacctcagaagttaatagaagaatgaaataatgcatgtaaattgctcagcagcgtgcctagcataaagtaattactcaaaccataatgtaaagtaaaaagataaccatactatacatagaaagccaatcatctcagccatgattatctcagaaataaaaagagatgcagcagctc

SEQ ID NO: 478 - DNA, 2216 bp, Homo sapiens
ctcacttccgcccggcgcgggcttggatggaggcggcgcggaggccgcggctggggttgagccgccggaggccgcccccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtgtctttcatggatgtgcaagaccttgaatgaccctggcagtcaagggtgagtgtcatccacaggagagccggccagccacgggctccatgggcagttgccccgcaccgcgcccacgcaggcccactgtgcagcccccaagtcaccagagttttcgagaaccacttccaaaagacaccgtcgtgaccggagccattagcaaatatcaggatttttcaaaccacacttcaatacatccttcactttaatttataaaacaaattactgagtataaaagtctcccctctgacgagcacagcattactcacacattgtgtataagaacggccaaactggtaaccggcacgctactggcaacacggcagtatttagccaccagccgcacaatggggtggagcggcccctgagtcatggaggcctggggtctctgcgcctggccaagagggctgcgtggcaatttccacacctgtgcaccaggcctcactcagaggcatgaggtggcgcgaccccctctcccagggagctcagaagacggctctgccacacctgacacctggcagctggcagccctgcctctaggaagcctcagctctggacagctgtgccttcacctgaggggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggaggggggtgaccgtgtgttcattcccttgggggaagcggagtcacgttcgcataagaatcctcccccaacgcccactggagagatgacaccaggcgggtgggactcaagggcaggctgggtcaccagctgcccaaggtgccggcctgccatggggctgcccgaggggtgctccagggacctgcacccagtgggactcactcatcgtctggggtcagctgcacgggctcgctggtgaactgtgtgtcaaagttgtccagaccgtagtcgtctgtgatctgtggctggaatggagggagcgcctgcttcttctccagcttggaaaaacaataggagaagggccagctccgcgcgggcatcatccctaccagattgagtgttttgcacgcacttcaatcacaaaatgaaacagtgagaaagtc

SEQ ID NO: 479 - DNA, 2245 bp, Homo sapiens
aagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattatcgtcacaatgtactaaactgtcaggtacttattacagtgccggaatgttttgaaatcctgttgcttgctcctcatcgccaaaaatgggtggaaaggatcagatatgttatatttgatgaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggattagcact

SEQ ID NO: 480 - DNA, 2267 bp, Homo sapiens
aacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacattaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacgtatacttttgtaatcagaaaatattaaatgcatgtatttttcaaaatc

SEQ ID NO: 481 - DNA, 2386 bp, Homo sapiens
agcagcagctgcggcggcggcggcgtttgagtggaggaagatggcggctccgggcggctcggggtcccgccagctgtgaggagccccgagcacggctgtcgcggcctgaggcagagcgcctctgctctggccctgtccctggctccctcattaccgtcgccagcggagcgaacccgagagcgtggagcgggctgggccagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtgtagcccatcagtgttatcatggtttcatgaaggctgtccaggaaggaaacattcagtgggagagccgtacctatccttatcctggaaccccaatcactcagcgcttctcgcacagtgcatgctattatgatgctaatcagtctatgtatgtgtttggaggctgtacccagagcagctgcaatgctgctttcaatgacctctggagacttgacctaaacagcaaagagtggatccgacctttggcttcagggtcctatccttcccccaaagctggagcaactctggtcgtgtacaaggacttgctagtgctgtttggcggctggacgcggccaagcccttatcccctacaccagccagagagattctttgatgaaatacacacttactcaccctctaaaaattggtggaactgcattgtgacaacccatgggccacctcccatggctggccactcctcctgtgtgatagatgataaaatgattgtctttggtggctctttaggatcccggcaaatgagcaatgatgtctgggtccttgaccttgagcagtgggcgtggtccaagccgaacatctctggccccagtcctcatcctcgaggtggccaatctcagattgtcatagatgatgcaactatcttaatcctcggagggtgtggcggtcccaatgctctattcaaggatgcttggttgttgcacatgcattctggtccttgggcctggcagccactcaaggtagaaaatgaagagcatggggccccagaactgtggtgccatccagcttgccgggtgggacagtgtgtggtggtcttcagccaggctcctagtgggagagccccactcagccccagtttgaactctcgcccatcacctatcagtgccactcctccagctctcgttcctgaaacccgagagtaccgctctcagtctccagtaagaagcatggatgaagctccttgtgttaacggccgctggggaacactgagacccagggctcaaaggcagactccttcaggttcccgggaagggagcctttccccagccagaggagacggctctcctatcctcaatggcgggagtttgtctccaggaacggcagctgtgggtggctcttctttggacagtcctgtacaggccatatctccaagtactccatctgctgctgaaggatacgacctgaaaataggactttctttggccccccgacgaggatcactaccagatcagaaagatctgagattaggatccatagatctgaattgggatctgaaacccgcttccagtagtaatcccatggatggcatggacaataggacagttgggggaagtatgagacaccctcctgaacagacaaatggtgtgcataccccacctcacgtggccagtgcccttgcaggggccgtctccccaggtgccctgcgtcggagtctggaagccatcaaagcgatgtcctccaaaggcccctcggcctctgcagcactaagtcctcctcttgggtcttctccaggctctcctgggagccagagtttgagcagtggagaaacagtgcccatccctcgcccagggcctgcccaaggagatggacattccttacctcccattgctcgccgcctgggccaccaccctccacagtccctaaatgttggcaaacccctataccagagtatgaactgcaagcccatgcagatgtacgtgctggacattaaagacaccaaggagaaggggcgggtcaaatggaaagtatttaatagcagttctgtggttggacctcctgaaaccagcctgcataccgtggtacaaggcaggggtgaactcatcatatttggaggactcatggacaagaaacagaatgtgaagtactatccaaaaacaaacgccttgtactttgtacgagcaaagagataatgtgttctaaacccc

SEQ ID NO: 482 - DNA, 1661 bp, Homo sapiens
gagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtcctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttagggaaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatact

SEQ ID NO: 483 - DNA, 2506 bp, Homo sapiens
ttgtgtctcttgtgaacccacttgtggagcgagagggaatttgggagggccaggggttagtctggcctctgtcttagctgtcattttggcggttttttttttttttcttcaggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagggtctcattttgtcacccaggctggagtacagtggcacgatcttggttgactgcaacctctgtctcctgggctcaagtgatccttccaccttagccttccaagtagctgggactgcagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatattcgacagaactggcaatttttcaaattgagtgaagccttatgtggactataagttatagattatatactcttattgataacttgcctaattgctatgctgaaagagactgcaggagaaataggcatctatctctgcatctgttttccccaccttagccttccaagtagctgggactgcagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttatttt

SEQ ID NO: 484 - DNA, 2771 bp, Homo sapiens
ctggctcctgtcctttgctgtctatgagcgacacttcctcaggacgacactaaaggcactgcccgagggcgcctgccacctcagctgcctgcagatagcattcttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccgtgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgagtgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctttccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcctagttaccccacaaactgaaggaaggagatccttcccccgtccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatctt

SEQ ID NO: 485 - DNA, 2068 bp, Homo sapiens
agcaataaatcaaaccaggagcaggtgcagcccggaggcccccccgtggggagaagcggctggggggtccctgcatcttgtactgcggcccctccaacaagtctgtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtctt

SEQ ID NO: 486 - DNA, 2142 bp, Homo sapiens
tccacacgtcctgctccccctggtgaagaagctgccctgggcttgtcgtcctagggtctccagacatgtctgaggtgaagagccggaagaagtcggggcccaagggagcccctgctgcggagcccgggaagcggagcgagggcgggaagacccccgtggcccggagcagcggaggcgggggctgggcagacccccgaacgtgcctgagcctgctgtcgctggggacgtgcctgggcctggcctggtttgtatttcagcagtcagaaaaatttgcaaaggtggaaaaccaataccagttactgaaactagaaaccaatgaattccaacaacttcaaagtaaaatcagtttaatttcagaaaagcttgagtctactgaaagcatcctgcaggaagctacatcatccatgtctttgatgacccagtttgagcaggaagtatccaacctccaagatatcatgcatgacattcaaaataatgaagaggtgctcactcaaaggatgcaaagccttaatgagaaatttcagaatattacggatttctggaagagaagcctagaagaaatgaacattaatacagacattttcaaatcagaagcaaaacatatacattctcaagtaactgtccaaattaactcagctgagcaggaaataaaattgctcactgaacggctaaaagatttggaagatagcacactaagaaatattagaacagtaaaaagacaagaagaagaagatctcctgcgagtagaggagcagctaggctctgatacaaaggcaattgaaaagttagaagaggaacagcatgccctctttgccagagatgaagatctgactaataaactttccgactacgaacccaaagttgaagaatgcaagacacatttgccaacaattgaaagtgctattcactctgttctcagagtctctcaggatctgatagaaacagaaaagaaaatggaagacttgactatgcagatgtttaatatggaagatgatatgctgaaagcagtgtctgaaataatggagatgcagaaaacccttgaaggaattcagtatgataatagcatattaaagatgcaaaatgaactggatattctaaaagaaaaagttcatgattttatagcatactcaagtacaggagaaaagggaactttaaaagaatataatatagaaaataaaggaattggtggtgatttttaaattcatgacatttattctgatgaaccatatcattatacataaattgattagtccattgattttgagttactttgatacgcctcatcttatcctacattattggaaaataaatgagatgtccacacaaatggattatccacataatcaaagcttatctttttaagcactaaaacttacttcattgtaactatttgaaatagaaatagttctttaaaaatatttctctacttttaaaacaggatacttaatatttttaatgttttttaaagcattaatggacatcatcattaatttcacctattatattgtacccacatatattgatgtctccaggggctaataaagagtatttaccacttcactaaatgaccccaatttgccattttcaaacctatgtctcataccttttctgtcacctgaacttactgtcaggttggttggtaatgtgcctgcctcagccagttcactttcttaggtaattccctgcaggttaagaatccacacaaccaagttcatgggaattttgtgtaaaataaaagataacatgcctgagggagagcctggtgcctttgctatgaattaatatgcactttctgaaaactctaaagcctgggaaacattttagtttttgttaaggttccaaactgtgctacagatacttgtaagacttttaaaatcagagtaagtatgttcttacataaggcctttcttaggaattatgtgtatataaatctttgaaatatctttatatacctgagttttaggttccaactgtgttagacatgagtttgctagatccatggtctctagatggtttacttaaataggccaggcgcagtggctcacacctgtaatcctagcactttgggaggccgaggtgggcagatcacgaagtcaggagatcaagaccatctggctaacagggtgaaaccctgtctctact

SEQ ID NO: 487 - DNA, 1989 bp, Homo sapiens
aaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaaggtgggagagaccaggggccccgggagggaggcaaatgagcattgagaaattctgggacaggagctcggcgagaaaagaaggggcggaagttcaaatagctgccacttggagggtttctcttagactatggacgctgtctcctctcctttgccgtgaagcagcgcttgatccgccgcctgcttggaggctggtccctttccccgacgcacaccctggcttctcactctggctggggactcccacagagagggcagctctggcaggggcaggggccactgtgggactgggacgaaggagcgactccctagcgtcctgcaaggcaggcgcagcgtctcctattctaggctgcagaacccgagctgagtgtcagtcgggatgtgacatgaagcgtctggcctggtccctcttcctttcaagctttccccgtccctcgtggactcggtccccctgccccacatttcagaaggctccccttccccctccacgtggacacacggcctcctcccctccccccttggtctgtgggtctgcaaggagccctcgcgggaagcaggaaggagcggggtcgcggagcggtggacaagccggcgccgttgctccccgccctctccgtagagctgttccgggcgccggtgctgagggtgatgggtccgcgggaggcccgcggcgcggcgctgggtggggtggtgctgcgctgcgacacgcgcctgcacccgcagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagcccccggggcccggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagggggcggctaccgtcccctctgcaggctcattcctccttggtctcctgcttcccctcacgcgaatttctttcaaagccatctgtttgcatccttgtgttttgctgtggtttttaaaggagcgcccacgaagtgtagtggctgacgatttcaacctcacacagcagtttgcaaccgcaagcattctctttgaattctcacagaattcagcaagaagtagaaacctgttatttactacattgtgatttaactttggatgtgaatttagtcacccttagcccttcagataagcctagccagtacatatttcagcacaggcagtttttttggtatttaagtacattgaggtaactgagcacttgagaatattttagggtcaaagtgtaattattcataatgaatttactctgttgatattaaaaagacgttcagtcctattactgatgagtttacatcttcaaataaatcctgggttctattt

SEQ ID NO: 488 - DNA, 2598 bp, Homo sapiens
attcagcttttgggtgaagacggaggcgggttctggacagacgtacgctgtcagggagtgtttacttcgcctccacttctgttcctccccgccctggtgctgctccgggtcacatactcgtcctgagccggcttcagcctctctgcgcagaagtgtcccggagccatggccgagtaatcttatgcgaagtctaccaagcttgtgctcaagggaaccaagacgaagaggtgggtcctgcacctccggcgggagcctcctcagttcttttcggacgcactccacccccctcgaatccggtggaagccgtggcgcggagagccggctttgtggcctcccaggctttgccctggcccctgtccgggctggactgaggccggaccgcggttcctggcgcctgtgcagagaggggcagcctcccgcactgacgaccctggaaacaggatagacgggcgggtgacccgtggccccgtacccacgagtttcggtcctctgaggcatctctgcaggcctctgcctgtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacgatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtcaaacaatgtgaaatcaattatgtaaagaaatttcagagcttccaagagcacaaacttaaaataagtaaagaagacagtaaaattcttaaaaaggctcagaaagatggatttttgcatgagacgcttctggacagagtcgcagtcatagcctgccttcatctctgaagggaccaggtaacacacggagtgccttggcagcctcatcattgcatgcaatcttcacagacaatatctcactgcagccacctttctgcaggagtacaggtgtgacattatactgatgacatcattctcagagaaaattcattttacacactgaagatacacagacacaaagagccttatacaaagggaatggacctttccccaacacagtagtgcaaggccctgccactttgcttcaattcctgaaaattccttggtaaacttggggctgctctattcctgacactttcaagaaatagttattcatcctctcagcatccacaacgttaatacaagcccaacattctctaatttgtgttttgttttttggagacacagtcttgctctgtcacacaggctggtatgaagtggcatgatctcagctcactgcagccttgacctcccgacctcaagcaattctcccatttcagctttccaagtagctaggactacaggtgtgtgccacgacactcagttaattttgtttatttttttgtagagaaaagctctcgctatgttacccgggctggtctcgaactcctgggctcaagagatcctctggcctccgcctcccaaagttctgggattacaggtgtgagtccatgtgcccagccctttaattctttacttggggttcaggtgactacatatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacacagtagatgctttagcaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatgtgtacacgctgcaattctcatctgcaggaagcactggcctccttcatccttaggctatagtgctgacactggcctccttcatcctcagactgtggtgccggatgtcacccctctgcgaggcccttgggatcgactgagtgaccagcagtgaagttcgtcagccttctgaatggatgccatgatcagatgtgatggagctcagtgggatgctgctgctttccctcccttagctaggatgtccctgataaaggatgacacccaagcctcagcacaactggccaaacttgaggtggtcatcatagcactgatgctgggccaacaattagccccatttgtacctttttacaaactttttgacaattgccaagaatcgtccaccttccctccccattgaattaaatacacttcttgtctcatgg

SEQ ID NO: 489 - DNA, 1941 bp, Homo sapiens
gcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagagtctcactctgtctcccaggctgcaacatccacctcccaggttcaagtgattcttgtgcctcagcctctccagtagctgggattacaggtgtgtgccagcatgcctggccaattgttggattgtatgaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacgaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacacactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtg

SEQ ID NO: 490 - DNA, 1984 bp, Homo sapiens
aaggtacatcaagatgcaaacaatttttttatcttcataacttcctgctcttattaacttgtattatgaatcaaattaagttttatgtataaggcatttactattccagtgacttagctaatgaaaacatttaaaaatatgtattaatttacttggcctgctactaaagtgcttaacataactaaatggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgaaattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccgggttcaagctattctcctgcctcagcctcccaagtaactgggactgcaggcacatgccaccacatccagctaatttttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaaaccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttaaagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtat

SEQ ID NO: 491 - DNA, 2236 bp, Homo sapiens
aaaactaaatgaagggaagcatacaaaaggctgaaagcaagactgctttaaaaccggaggaaaattgaggaactgctaaggcaacctggcctgagttcagctgtgcaacaggcactttgggttttaatcttttgcgttcttcaatgctgttttcagactccagatatactttggtattgttttctctcttcctgcaaagctgaggcagagtcggactcctttactgtgagttgaaagatgtgagaataaggcattgctggaagcaacagtttggcagcctggggtacactcaggttattcgttacaactattattatttgatgtcttttttttaaactcaggtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtgacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgactggcacagtttggaatccaccaaagaaaaaacgcttcactgtcaagctgcaaacattttttgagacattcctgagagccagttcacctcaacaggcttttgacattatgaaggaagcaattggcaaactactgctagccgctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctggagttccacaaatt

SEQ ID NO: 492 - DNA, 2375 bp, Homo sapiens
aatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacagcaatgcatcctcaaaaaaaaaaaaaaaaaaaaacggctaaaactgtgtcaaaatgttcttaaggagcctatggtctccacggtgctaaaaagagcctggtgctgggccgactggcagggctgagcatcctcctgccccctcgccactgatgtttactaagcactctgagccaatgagacccccagcagcagaaagggcacaaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaatatc

SEQ ID NO: 493 - DNA, 2448 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgatttttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcatagaagatatgttcttgttaacattgtatacaacatagccccaaatatagtaagatctatactagataatcctagatgaaatgttagagatgctatttgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 494 - DNA, 2342 bp, Homo sapiens
ctggggtcgtggccgtgggccggcaggggcgaggcgggcgtccggagggcggataaaaggggccgcgctgcgccggggccgctttctccgcgcggtgcctgcagggctcccagcgagtggcagcttgggaggggccgcccgggcggtcagactggcacctgagcggccaccgcgtcccggccaggcgggcagaccgaccccctcctcacctcgcgcgcggctgacgcaggcagggcgcccggcccctcctggggaccatcaggtgccggctgggggctgtaggcaccggacggaagcaggcggtgtgaggaccgacgacgcgggcatggcgggggcggcctgcgagccggtggccaggccgagcctgacctccatctcgtctggggagcttcgcagcctgtggacctgcgactgcgagctggccctgctgccgctggctcagctgctgcgcctgcagcccggtgccttccagctgagcggcgaccagctcgtggtggccgggcccggggagccggcggcggcgcgggggggcttcaacgtcttcggtgacggcctcgtgcgcctcgacgggcagctctaccgcctcagcagctacatcaagaggtatgtggaactgaccaactactgtgattataaagactacagggaaactatattgagcaaaccaatgttgttctttattaatgtacagaccaaaaaagacacctcaaaagaaaggacgtacgcgtttcttgtaaacacgaggcaccccaagataagaagacagatagagcaagggatggacatggtcatctcctcagtgattggagaaagttaccggcttcagtttgattttcaagaggcagtgaagaatttcttccccccaggaaatgaagtggttaatggagaaaatttaagctttgcatatgaattcaaagctgatgcattatttgatttcttctattggttcgggctcagtaattccgttgtaaaagtaaatggaaaagttctgaatttgtcaagtacaagtccagaaaagaaggagacgattaagttatttctggaaaaaatgagtgagcctttaatccgaaggagcagtttctctgaccgaaagttcagtgtaacttccagaggttcaatagatgatgtttttaactgcaatctgtcacccagatcatctctgacagagcctcttttggcagaattaccatttccaagtgttctggaatctgaagagacacccaaccaatttatctgattgaactgaacattgtagcagttgctcccgcactccaggcctgtgctagactataggctggggggagggtaggaggtgggaggcagatacttccacctgcgtgtcaatctccggctcctccatggcttctatggaggactcctctcttctgcttctgtggatgtgatgccctggcaggcccagggcagctgattcccctaaaacttatgattaccaggatggaaaggccttggtcccatggcactgggtggggctgggggatattctctactttgaacacttctccaaagaggcagaagggccacagagttctgccaccctgaacatttttctcagttccctgggagtttttgtggcagcctttgtgggagtggtctgactggctgttgacctagcatgcttcataaatcagggtttggccctctgcttggagcatccaaccccttgaactcaaacctgtcgagcaaggggttaagagttctgttctcttgccaacctggctgggcaaaagcctgtgccatctttcactgggaggcaaatatgtttttcatcctgccatatgacacctatgagaaacgttcacagtgaggagtagccaggttgctaggacagtaaccctgccacacactgcctgaaatcggaactcccttggcctccctcttaactaagtgacccatgtagaaggaagccaggagatatggtaccgaacaatgacaggggaagggtattggacacggcagcgtcctccttattgaaaacacattatgtcagttgggaattttaaataagcttttagcaaacctaacactaaaagcaaaatagaagaaagctataccattaccataatacatttttcatctcatggctacaatggaattcttgaaaaggaaaaaaaatcctatctacatataaaaacctgcatgaatgaatcactacatatgcttataatgaggaagagttatgggtcctgagtgtaattttttatcctttcttaaaaagtttctgtattatgcattttgataacactactgatgatccttccacttatatttgaaatgttatgtaccacatttgcacaattaaaacttttcttagcgttcaacct

SEQ ID NO: 495 - DNA, 2026 bp, Homo sapiens
tataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagagtggggtctcactgtcacccaggctggagtgaagtggcatgatctgactcactgtacttttggcctttctggctcaggtgatcctcctacttcagcctcctgagtagctggggctacagaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccccccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaatctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaggcgaacatttcatgtttggcgggcatgtgagtgcacaagatggaaagagcgattggagcatcctggtataattacccccattgtgctcttaatggaaatttcaaagaacgggagtattctgttggttggtgtccaggtttgtggcactgttccaagaggccttacacacacacacaaatatacaattttctatacatatatatcctctagcttgaaacttttgctcaagtttatttatgtcactggctggctggatccaaagtcatgtgtccacacattcataaataaaaattttacctatg

SEQ ID NO: 496 - DNA, 1905 bp, Homo sapiens
tggtcagctggggtcgctctcgggtggttgggtgttgcttgttcccgctgttccagcgtcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacaccgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcatatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttctatctttaactcaaataaagcgtgtaataaataagttaaaaaaaaaaaaaaaaaaaaaaaaaaaag

SEQ ID NO: 497 - DNA, 2475 bp, Homo sapiens
taaaaatggcctgcaaaccttttttatgatgctatttttattaatataaagtcctgtttattgagaccctttaaatgcctgcgagagaccctacagacagtatgtctactcctcacagcatctctatgaagagaaggagggttgtgcccacttcatagatgagaaaactgagaggtgaggtgacttgcctggggccacatagctcataagctgtagaactctgcaggcagatttactgtcccaggagcaaatgctggatgagcaactcctgttctttgggctcaaggggactggtgatgggacaattcttctcgacttcaggagctgacagagccagaggcacctaaacttgggtacatcttgtaagacacataatgaggtccctctagctttagctggagggagataaaagaaccccagacctctgaatgtcccagaggctagtctcttctcagagcagcactggggtttgggggcttccctgggcctcagcctccaggcacccccaggattcccagagagacgctgtgattggcaggaggcaggatatccccagggaaacccatcttcacgcctgggtgacccccactgccgcctccttcttaactctgcaggaaatcagagctggcagcctccagtgggaggacagagccggtttccgtggcaaccctcagctgcctcatcgtggctgggaagggaaggaagcaagccggcagaaatagctatggaaggtcttgcgcaggctgcaaccctggtgtgctgggcgaaaacccttatgactccccccttccaaatcaggctgggttgtcactgagactagattctcacctgccttcaaagaagggccaattccctttaaaggtcgcgcctccttggaaccacagtcattagtgaattacactcaaggaaaagacgtgctcccaccaggcagctccagctgttacctgagatactgaagtgcagctcaggagacgatcatttaaacctgcccttgttttaatcgttatttttctctttaaaaaaaatagaagctataaagaaaagagggagagatgagtgggttagctacctgctatgcgctagttaggaagttacctggatgccattgtatttcttcatcccttgcttaagaatcaaaattactggacatatgttaggaatactctttctttctttctttctttttaagctcagtggcaagaatgaaatactcttttttttttttttttttgagatggagtctcgctctgctgcccaggctagagtgcagtggcgtgatctcggctcactgcaagctctgcctcccgtgttcacaccattctcctgcctcagcctcctgagtagctgggactgcaggcacccgccaccacacccggctaatttttggatttttagtagagatgggatttcaccgtgttggccaggatggtcttgatctcctgagctcgtgatctgcccgcctcggcctcccaaagtgctgggattacaggtgtgagccaccgcgcccagccaagaataaaatactcttaagttgatctaatgaagtgtttccttaccattgtgattattgttactattatttgctatattttaatattgttgtttaccaaatattctcctttaaacagactcgctttttaaacttttttttttttttgagacggagtttcacgcttattgcccaggctggagtgcaatggcacgatctcagctcaccacaacctccacctcctgggtttaagcaatgcttctgcctcagcttcccaagtagctgagattacaggcgcacaccaccacgcccaactgatttttgtatttttagtagagacggggtttccccatgttggtcaggctggtctcgaactcctgacctcgtgatttgcctgcctgggcctcccaaagtgctagggttacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgctacaaaacgagataagcaagtgttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttgatgattaaaaagaataaacacagtgtttcctgagtagcagtgattgttatgccttgctattttaataaagattctattttcgtataacattgtcaagtggaaacatgctgaaatctattaaaccatctttgtttgtg

SEQ ID NO: 498 - DNA, 1931 bp, Homo sapiens
aatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccctcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatgatttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaatactgtatgtatgtagagattgagttgtc

SEQ ID NO: 499 - DNA, 2230 bp, Homo sapiens
gtctcgctgcagcgggtgctgcaggtctggccttcacttttctgcgtcctcttactcctagaggcccagcctctgtggcgctgtgatctggttattgggagattcacagctaagacgccaggatcccccggaagcctagaaatgggaccactgacatttatggatgtggccatagagttctctttggaggagtggcagtgcctggacactgcacagcggaatgtatataggcatgtgatgttagagaactacagaaacctggttttcttggccagacctgattacctgtctggaacaaggaaaagagccctggaatatgaagagacatgagatggtggtagccaaacattcagctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaaggaacaccaaggaggttataatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcagagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatatgaagaatgtggcaaagcttttaaccagtcctcacaccttatgagacataagaaaattcatagtaaagagaaaccttacaaatgtgaacagtgtggcaaggtctttaagaagtcctcaactcttactgcacataagatcattcatactggagagaaaccttacaaatgtgaggaatgtggcaaaggtttcagccaactctcaaaccttactaaacacaagaagattcatactagagagaaaccctacaaacgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttataatcctcaaaacttcttacacctaaaattcatgcaggagagaaaccccacaaatgtgaaaaatttggtaaattctttaacaaatcttcaaccctttctgcacataatataattcatactggagagaaaccccacaaatatgaagaatgtggtaatgcttttaaccaattctcaaatcttactaaacaaaattaatactgaaaatgttacaaac

SEQ ID NO: 500 - DNA, 2392 bp, Homo sapiens
cctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttac

SEQ ID NO: 501 - DNA, 1692 bp, Homo sapiens
aaaaaaaagatcttacacctgagtgtaaaatgcaaaactataaacggttagaagattacttgggaggcaatctaggtgccctcgggttcagcagtgactttttagctacaacaccaaaggcttgatcaatcaaagaaagaattgataagtagatgtccagttgataacctggacatcattaaaattaaaatcttgtgctctgcgaatgacattgtcaagagaatgaagagacaggccacagacttagagaaaatattttcaaaagacatacctgacaaaggactgttactcaaaatgtttgaagaattcttaaaacttaataagaaaatgggccaaagatgtggacctcaccaaggaaaatatgtagatggcaaataatcctatgtaaagatgtttcacatcatatgttatcagggaaatgcaaattaagacaatgagacaccaccacatacctactagaatggacaaaatccagaacactaacaacaccaaatgctggaggaacaaggactctcatcactgcagatgggaatgcaaaacagggcagccactttggaagacagttgggtagtttcttacacaactgaacatactcttacctgtaggatccagcagttatgccccttgacatttatccaaatagatggaaaacgtcaataaacctgcacatggatgtttatagcagctttattcataactgccgaaacttggaagcaacgaagatgtccttcagtaagtgaatgaataagcaaattgtggtacatccagacaacggaaaattattcagggctaaaaagaaatgaactgtcaagccatgaaaagacatgatgggaccttaaatgcttattagtaagtgaaagaaaccgatctgaaaaggctacacattgcaattccaactctgtaacactgtggaaaagcaaaactgaggagaccccaaaaagatcagtgactgccgaggactgggaggagcaggtggagcccaggggccttgcaggacggtgaaaccgccccgtacgatgccgaggactggaaggagcaggtggagcccagaggacttgcaggacagtgaaaccgccccgtacgatgccaaggactgggaggagcaggtggagcccagaggacttgcaggacggtgaaaccgccccgtacgatgccgaggactgggaggagcaggtggagcccagaggacttgcaggacggtgaaactgccctgtatgatgccgaggactgggaggagcaggtggagcccagaggatttgcacgacggtgaaactgccctgtacgatgctgtcatggtgggcgcatctcattctgcgtttgcttcaactcacaggatgtacgagagtgaaccgcaatgtaaactgcagaccggggtggcaacgtgtgtcagcacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaat

SEQ ID NO: 502 - DNA, 1504 bp, Homo sapiens
tttgaactcctggcctcaagcaatcttcccaccttggcctcccaaagtgctggagttacagacctgagccaccatgcccggccagataattctttgacagataatcctgctgacatgaactagacttccttaagacacatcatagaatcaatagcccagaaccataaagagcctctacttgtaagtttagagtcattttaagtaaggtagaactggagatcataagagatatgtactcttataatttttgattgtatgtttgtttctttttgagacagagtctcactctgtttgcccatgctggagcacagtggcgcgatcatagtttgttgcagcctcaacctcccaggttcaagggatccttgcaactcagcctcctgagtagctgagaccacaagcgcatgctatcacactagctgatttgatttttttgagagttggggtctcactaagttgcttaggctggtctcaaactcctggctgcaagtggtcctcccaccttggcctcccaaagcgctgggattacaggcaggaaccacggtgcttggccaacaatttgcatgcctttaccacattccccaaatgttaacatttcacctcattttcttatcagtctctttatgtataacatgcatatgttttctgaatcatttaaatgtaaattgtgacataatgccccttttcccctaaatatgtatttcctgagagtaagaatttcattatgtatttcctaaaagcaaaaatgttctctttcccagtcacacaaaattatcagactcaggaactcaacactgagttcttcctccagcacttgacaagaatcaaagtgttggttagtgactgctttgggggatggggcagcactggcagcaggtggcccgatggcctgggtggtttgcctgccagcgatgctggtgggcaagccctgcctggaagctcctctctcccacgtttttcctgccgcccagtagttagaccacctggagccagaggagggggcccacccggtttcccagcctgtccctccagagctgggctccatttctggaggtagagaatggggcaagtctgggcatcttgtgctctttgctaggggaggaaagggctgtggctgctttccttgtcccccatttcccttctgccagtggggccaagccccagcagctcagtcaggagaagaggatatggatctgtctgggcctctctctttaagagaaagttgattcgtgccttccggatagtcttgttccagggtttctaaactttctgatcccaccttcatgttaaaatgagttttgatcatgtgtctctttagtaatatggacattataaaataggaaaaaaaagtctcttaaagcctaagtagttaaaaatttattttcacatcaggcatagtggctcatgccagtagtcccagcacttttagaggccaaagtgggaagatcgcttgaggctggagttggagaccagtctgggcaatacagtgagaccttgtctctaaatt

SEQ ID NO: 503 - DNA, 1745 bp, Homo sapiens
gtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccgtcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagataccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatccaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggttggcctgtgcatcggcaattctcatatctgtttttttcaaagaataaaatcaaataaagagcagg

SEQ ID NO: 504 - DNA, 1861 bp, Homo sapiens
attaatggacttgtacaaaccatcctgtgcagtttacaacaaaaggaagcgaaacaactccccaggctggccgggcagtacaccggagatgctttgggggcccagctctgcagattccactccgccggcgactccgctttgacactactcttgaggtcgggaagtctgccggcatcctcgaaagcagcgggtttggttgcagcggcggcggaggccagatggtacaagaagttggcctgcgcctgcacgctgggaggcttgcagaagctggtgcgcctgaatcggatgctctgcactgacacttggctggagccggagctggagtccgactcggtggacgagtcctcctcctccgagctgacttcactggaatccgaggccccgctgcccccctcctcctcctcttcctcctcctcctcctctccctcctcctcctcttcctccgaggacacagaattgctggagctggacaaactggagccaaaatccgagtcgttggccgcgtggtccgagtaggagctggactcggagtcgctgctgcagctctcgggaaagctgcccagatggggctgcggccggtggtggtgaggggggtggtgactctgctgcggcggctgggcccggtggtggtggtggtggtggtgatggtggtggtggtggtggtggtgcggaggcgggcagaagccgttgaccagatgaaacctctccaggcaagtggcccccgcggcggcggctgccgggtgtttgctgcacagcaggctccgaaaataagcagggtccgaggggaaggcgacgtagtttccctggagcggggcagtttcatagtttagagggggtttgcacggcgagcgcacgatctccgggtagtgcgagccggggtatttgctaaaaatctgaggtagatgggcggcggggcgcgcggcggcggcgcccgggcgctgggactgcgcgctgattggcaggggccgcgcggctccgctcaggccccgccaaagttggtgcttgtccttccaaaatcccgggcgggggctggcggcagcggcgcgctctggcggcggcgcctttgtggccagggcccggccgacccgcctgcgcttggtcttgaggacgcgctcggttttgcaggaggtgtagagcgcttccacgtcttcccgggagatgagcgtgcatttggcggcgtggaaggcgatgctgttaattgccttgagtttccgcaactcctccagatcgcagtggtgcttcttcactttcagatgatccatgcgcttgtgcacggtcgtcctcgggatgtttttcagcagatctgtgaagacttgggagagtgcaaacatttgcttccctttaatgatgaggtagccgagcctcacgccatccacctcttcaaaacctgacttcaggtctcccatctcgggcactaaatgatccccaccatttgcagtaaatatatacgtgacgcatacatacacatgtatgtatgttaatcctcagccagatgctgcgtgtgtctcaaggcatcctgctaataaaataacaaagactgttattcccggcgaaggaagtgccaaactctaggcgaaattattggggggggggaaaccccatgaaattacactgacttgattcttgcttttttgttgttgttgttttcgtttttttaaaaaagagggaaaaaaccatccggtttctgatctgccagtgtgttggtctgagtccccgatgcagatcagtacctgggcccctctattccttccttctccattggagcactatgataatggaatgtgaagggagaaagagaaaagaaatgcagctgctattcccgccgctgctttagctacaaataaaatgacagagtgaagtg

SEQ ID NO: 505 - DNA, 1669 bp, Homo sapiens
aaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgatgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattcccac

SEQ ID NO: 506 - DNA, 2450 bp, Homo sapiens
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaggtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaat

SEQ ID NO: 507 - DNA, 2012 bp, Homo sapiens
agcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagagtagctgggatttgacttttcttccttgcctgcagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaac

SEQ ID NO: 508 - DNA, 1515 bp, Homo sapiens
gatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgcccaccccggactacaccgagagcgacatcctgagggcctaccgcgcgcagaagaacctggactttgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccgggtgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccagcccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgttt

SEQ ID NO: 509 - DNA, 1684 bp, Homo sapiens
tttgctgatgaactcgttgaccgtcatgagggtctgggaccattcctcatctgtgtacctcgaaccaacttccactgggacagttcggcagccagcgatctcctggatatactccaaactagcagaaagacacacattggcatcgtcactgctaatatctgttgggcatagtactaagtgtgctttgcatgtggtcccctttcatcctcggaaaacctcacgtgcagagacaaggactgtcatccccagcttcactgatgaggaaccggcatggagaggtggggctccctgctcaaggctgtgtggctcatacacagtgctgtgcagctttgcagacagggccggtaagtctggttggctgggctgctctagttccctgcttgccaacagcctcctcacttctttctttgctcattttgtcactaagctgagaaacctttgaacaaatagcggacagcgtggcaggtggcagtctcctggactctgccctctagcctgggactgattccaggcctcatcagttacaggccaggggatctgaggcaggttactgaacccgagtccttgatccccatttacagaatgggggtgatgacaacacctgtcctagtgccaggtacgtagtaaaatgcttaatgaagccttgctgtgaggagagctcctgcaatgagaattcctccacatgtgtcagcgggtaccattccctccgcgaaaccacaaaacaggcggactccatctaccttcctggagagatgcctccttatttccaaactcatgcagagccgcggcatgacagccacgctccagctgcctgatctgatctccccatcatgattctgagaaaggactagaaacaaacacaagagaccacagaatccctcagagagagaggggctgtctcttgggttatttctgctcttagcttcagggccctgagatggtctgaaattgctaggatcctgtaaaattgcataacagaaacattctaggactgccacttagggactcattaaaaaaccgcttaaggcgagcaaggtagaaggtaagaatcccataacctgcggcataaattcagagcaccttacttttcactcttttttaaccccttggcaatcagtcaagggctgctagtgaagcatctacaaggttgcatttccctggggatggtcgggaggaattcagggagccctggggaacgctaaaatgggaaaagggacctcacctccctcagcgaccacccacctccacttctgcatgcacggccagtggtcagccacgcctttcaggatcacgggcctccctggaaccaaaaactgctccctgaaatgctggagggacggacggtgcagccgggggactgttttttctaacttcacatctggaatcaaaccatggtccgcccttgctttctgtttaaaatcaaaacagaacaaaatagcaaccacctcaggaagtcgacatttgaggtattccaccaggaacctgtgtcaggggtaggagagcttagctgtcaagagtaccagtaacaacaatagacaacgtttgttattattactgctactattactatttgctcctcatgagatcaaggtggtttttttcttaaccatttcatcaaaaatgtttgtttcattataaactgctttcacagacattctgcaataaaggaaaacttactatctcc

SEQ ID NO: 510 - DNA, 1512 bp, Homo sapiens
acttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggggcccttcggtcttagaagctgtttgacatgtataataaatggcattgactggg

SEQ ID NO: 511 - DNA, 1670 bp, Homo sapiens
agcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatacttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctc

SEQ ID NO: 512 - DNA, 2197 bp, Homo sapiens
agagccggtgcgacgtttccctttccagctttgttcttccggccctgctgtctgcctccccggctgattggattcgttactgctttgcaacgcgcacctaactccagacggggtctcactctgtcgcccaggctggagtgcagtggcacaatctcagcttgctgtgacctcagctctctgcgacctctgcttgctggactcaagcgatcctcccaccacctcagcctcctgagtagctggaaccatcatatgcaccagcacgcctggctaagctggaatgcaatagcgtggtcttggctcactgcaacctccgcctcccgggttcaagcaattctcctgcctcagcctcctaagtagctgggactacaggggccctcctgctgctccctccatgaggctggtcctgaaggaataggcctgtggctcgtccctcctccccatctcggccctgaggcagacataccttccacagctctgggagcaccgcctccacccaggtctcacaggatgggacacaaggataggcattaagcaggacttccagggcccgagggaagttggcgcagtgtttcagcatctaggggtcaaaagagggtcttgggcacatgcctcccccacccgagggcagacccaagtcttgcctcacccacatggccaatcctagcctaatctggggggctaaggtctgagtctctcttcccttttttgtgcctctgtctaccccaccctcaagtatgctccaaccttttggccccagttttcctctggggctcttccctcccttggactctctctcccagaatcctctctccccctcccaagctggggacagccccctggccactgagggcaggctttcagtctcttggaccctctgtcttccccagaagcggagcagttccagccgcgggctcccccacacaggagcctcctatgacagggcctcccagcgcacctcagggcgcactggctgcgccccgtagtccagcagtgcggcgaaaaggacttcaggctcccagttgggggcgtcctggacggcctgcagcgcacagtccatgggcgtgtggcccgccccattggggacctcagcgcgggccccgtaacgcagcagcagctcggccaggcccccgcagccgctggcacaagcgttgtgcagcggcgtgtggcgcttgcgcccggccgcccgggcatcagctccagcctccaggagccggcgcgccgcagccttgtgtcgcctgcagctacctgggccctcggccccagcgcacgccgcgttcagcgcagtctcgccctggctggtgcgcaggcccacgtcggcgccatgctccaggtacagagccacatgttgctccaggccgcgcgccgccgccacgtgcaggggcgtctcctggctctcgcctgctgccaggttcaccgtcgctcctgcttccagcagcaacttggcgcacctggggacaagagagcaaggtcctgaggaaaatcctgaaggcttgggaccccttcagcttgctgtgacactcccttgcctttccacccctctcaccttgaggtcctacctggtgtcctccatgagaatcatacaagccccgctacagacaacagaattggaaggtcctgagagctaccagaagcatcttcagttttcatatgaaaaacttaagcccaggagtgatttgtgcagccaaggacacacagcaagttagtggctgcaccagaaatagtactcactgcctcagacagtccctcccacagtctactctgtctccaccccaaggtctggttctgaatcattcagttgtcagttgtctcctttttttttttttttggagacagggtctctctctgtggcccaggctgaagtgcagtggtgtgattacagctcatgtagcctggacctcccaagctcaagcaatcctcctgcctctgcctcccaagtagctgggaccacaggtgggcagcaccacacctggctaattttttaaatttttttttatagagacagggtcttaccatttgccccagctggtctcagacccctgggctcaagcaagcctcctgccttggcctcccaaagtgctgggattacaggtgtgagccaccacacccggccttatctcctaacattttgatagcacaaaattttgaaaacccacttctgtgtacgttatgaagcatagaaaattaaacagtatgcacc

SEQ ID NO: 513 - DNA, 1697 bp, Homo sapiens
gtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgcttatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaaggaattatctggacttttttttttttttttttttttgagacagagtctcactctgtcacccaggctggaatccagtggcactatctcagctcactgcaacctccgcctcccaggttcaagcaattctcctgcctcagcctcctgagtagctgggattacaggcacacgccaccacacgcagctaatttttgtatttttagtagagatggggtttcaccatgttggtcaggctggtctcgaactcctgaccttgtgatctgcccacctcagcctcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactc

SEQ ID NO: 514 - DNA, 1974 bp, Homo sapiens
aggaaaatttagtatgtaatccagtaaatatcctaagttatttattttcatgtgtgtgtgtgtgtttaaatcaagtaacccttttaattgaattttaaaatgacagcgaattttgacattctgagaaatggggattttgagatgtttctctccatatctccctttgtcctgtgtgtgtggccgacgccctctggatgaagaggctgtagccgttgagctccctgtgggggcctgtttcatcccgaggggactgcgtgttgctctgtgtggtttgagagaagctgctcttctctgttacttcccttctatgaaggtagaagctttcagtgttacaacttctgatggcggaaaatttagtttttattaataattccttcttggatagtctagtgaactatattaatagaacagtgtactgttcacagaaaagaacttgtagggagttttttgtagtgatatgctctattaggatacagaacaatctaagagtaagcttgatagacatgatgtgacttcacttaaatggagtagagtgaataatgtaaggacactcacctctgttgaaattggtgatttctgcattttgtagacctttgccctctaagtttatcatcatattatctgttgaatctgaacagcatttgaagtcctctcaaagagtttgagctttcaggattaggttcccctgtgagtctttcacttgtgtaatggtaagtcaacattgatgatctttctaaggaaatcagatttacaaaatgctgagccgcttgatgtctaagtgttggtggtttttgctgttgctttgctgttccatgaaagcgctccctggctgcttggagggctgtgcttttccaggtcagtgccagcttggctgtcccaggccgtgcacagtgcccattgctatagctgggcccagtcctggccacgccggagcctcggcgggggcagctgggttgtcacggcagcacagtgcacatgcagagaggaccaggccatgtttttcctgtgctgagaaactcttgggttatttaatttttccaatgtgttttcataactcatgattatttgaaatacacttgtgttagtaactgcttctataattaagtggtcactgtaaaaaggcgaataacctatttttatatcagaatgtccaaaactcatgggtttgctttgttatagaaaaatgtgccattcatttgttgggtagaataaagttgtcttgtaattgtatctgctcttggtataactaaaagaggatattttgatttcttcctaaaatgttaccaagcaactgttcttcatgttaatactaagattcttgatagttccatttaaaagccacaagaagtcattctggtttattcctcactccaagggaacacttactttgtgtagacaagaagatgagagtctttccttcaggatttctaaacacagagcaagaagattcaatgaaaaattgggctcagggcagtaattggggctggcatttattcttaagagttttctccctcaaaaggtgaaggagtgacattgcgtattcactctgtgtgtgtgtgtgtgtgtgtgtgtgtgtgtgtgtgtgtgtgtgtgtgtgtgtagctctagagggagtagggagaaaatacaggatgaaattgaaaacagggactaacaacttttcactgaatgccagcaagctctctaaaattagttttctttggttgaacaaatttacaattcattgtacttcatttcacagcattaaacatttactcgaggcagtttattctgtttgctctttcatcccccttcttatttacttttttcttgtgctctaaaacttttgtcaatctttaacaaaactgtgctgttaccttttttaatgttaaaagaattttaacactgtcaactgtagtttgtgcagatgtatgtcagaaaaaaatgtacagtatgtgtcaaaatatatttgaatatcttgttgctgttgctgtt

SEQ ID NO: 515 - DNA, 1643 bp, Homo sapiens
ggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcccggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctt

SEQ ID NO: 516 - DNA, 1710 bp, Homo sapiens
gtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaaaaagaagaagaagaagagaggaccaaaagttcaaacagaccctcccccagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgagaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgaagataaagaaagagatgaagatgatgaagatggagatggcgatggagatggagcaactggaaagaagaag

SEQ ID NO: 517 - DNA, 1970 bp, Homo sapiens
atgctgttcccttgaagttatggctgagctgttcttagaactggtctactcaattcacagaaaacataggtcatgccttatctatgggggaacaccctcccagaatttacctgtgattacctgcgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccaggcacttgaaagtgactgcctaatccctacaattactagccttgttggagattatgcagcccacaagtacagactagtataaagcaaaaggacaaaggaacccccaccctccaccccacccattaatgacttgagtgggcaagaagaagtgatggccttccttgcctaaaacagtagctttgtttttagggggtgggaaggtaggatgtggagtgacatggttctatcctttacttatgagactcagaaatatatctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacatt

SEQ ID NO: 518 - DNA, 2222 bp, Homo sapiens
gatgcccgcctactggcgccctagcaaccgggttgcgaaccatgttctatcccgactaagtggccgtcctgggagttatagtgccactagccggcctcggctgttccctgtccgaggctcttgtcatttccgcttatttcctccacgggtgccgatttcatgtgtgtgttcccgagtgcctgagccggctcccgaaatgagtactcgtggtttccgcgtgggaaccaacctcgagcgccagtggcccgccctctccgggctgaggtggctgctgaggctggggctgctcctgaggcttcagggccgcccgctgcacggctttctaccttcccaggttagccgcggtcaacttctgccaggcggagcgagaaatcgcattttgtcagcctactgagaggtgacagtgtgctggcagccctcacagccctccctcgctctcagcgcttcctctgcctgggctcccactttggcggcacttgaggagcccttcaacccgctgctgcactgtgggagccccttcctgcgctggctgaggcaggagctggctccctcagcttgcggggaggtgtggaggagaggcgcgggcaggaacagcagcagtgtgacttccgggtgggcgtgggctcggtgggctgcacactcagagcggccagctggctccgccggcccggggcagtgaggggcttagcacctgggccagcagctgctgtgcttgacttctcgccgggccttagctgcctccctgtggggcagggctcgggacctgcagcccgccatgcctgagcctccccccgccatgggctcctgcactgccggagcctccccgacgagcgccgccccctgctccatggcacccagtcccatcgaccacccaagggctgaggagtgcgagtgcacggcgtgggactggcaggcagctccacctgcggccccggtgcaggatccacggggtgaagccagctgggctcctgagtctggcgaggacttggagaacctttatgtctagctaagggattgtaaatacaccaattggcactctgtatctagctcaaggtttgttaaacacaccaatcagcaccctgtgtctagctcagggtttgtgaatgcaccaatggacactctgtatctagctactctggtggagacttggagaacctttatgtctagctaagggattgtaaatacaccaattggcactctgtatctagctcaaggtttttaaacacaccaatcagcaccccgtgtctagctcagggtttgtgaatgcaccaatcgacactccgtatctagctaatctagtggggacgtggagaacttttgagtctacctcagggattatagatgcaccaatcaacaccctgtcaaaacggaccaatcagcgctctgtaaaacagaccaatcagctctcagtaaaatggaccaatcagcaggatgtgggtggggccagataagggaataaaagcaggctgccggacccagcagtggcgaggcgcttcggttgtcttccatgatgtggacgctttgttcttttgctctttgcaataaatcttcctgttgctttctttgggtccacactgcctttatgagctgtaacactcaccgtgaaggtctgaagctttactctggaagccagtgagaccaggaacccaccgggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctacatatccttacaatttggtttagaattttagtaccactaacattttttggtgcatattttggaaataaagaaaaggtaaactctt

SEQ ID NO: 519 - DNA, 2141 bp, Homo sapiens
gaacgaagaaggcgtcccggcatcggccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgtagagaagtctccccggccacctcttaaggagaggagagttcagagaattcaggagtcaacatgcttttctgcggagcttgatgtccctgcgctaccaagaaccaagagggtggctcgaacaccaaagccttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagagggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagc

SEQ ID NO: 520 - DNA, 1594 bp, Homo sapiens
cttagttcaattttttttttttaatggacattcaaatctgtaaatactacactgctcttaagacctgatttgaaatttcacaggaaggcctaatcctatagtcacaaggtaaggacagttgagtagtgtaagaaccccaccctgcttgtagagaaccttggttttcatagaaaggaaaggctaaaggttttctagcattgttgcccttctttgtctgtcagtcagttcaccctctgtgattctccatggacccgcattgcagaaaatcagtcccatatattagtgagccatgtactgcccaatccgggggctcctggggtgtggtgtgtccaccagtgactctccggacactagcttcagtaaggatacttcttatttcggttgagaatgcagaggcttttattcgtggactcacatcactgcataggcacaaagaatgtgattgccatttgctgcgtgagaaaaagctgggctccctatttcttttttgggttggactctgccgtgcagccataggacaccaagcctcacgcactctccccttgggacagtagtgtttgggtgaatgttactgcatcccgttttttttcttttcttttttttttttttttttgagacgaaatcttgctcttgtcccccagactggagtgcaatggcacgatctcggctcactgcaacctccacctcccaggttcaagggattcgtctgcctcggcctcccaagtagctgggactacaagcgcgcaccaccactcccagctaatttttgtatttttagtagaggcggggtttcaccatgttggccaggctggtctcaaactcctgacctcaggtgatccacccgccttggcctcccaacgtgctgggattacaggcgtgagccaacacaccggaccttcattttttaaattaagctgggacacaagttttgcctccaggctggatgttgatcctgctctgtgctagacagatgtgcggagggactgttccgggctcggcttgaccttttcctacctagtttctccctcttgtcctgcacaagaggactaactgaactctaacgtcagaacggctgacgagcagttgattgtccttgcttgtgttgttgacaggggtgggtggggtgggagcaggggtatggatattgcataagttattgaaatgctgacccccattcaggaaaccatgcagccccttcccttcccttcccttcccttcctttcccttccctagccagggctcaggtacctcactctcctgccttgtgcgtagctcctggggccccggtcagtccccagcagccttggcacacagtgtctggagcctctgctcctgctgcaaaagcagaaaccatgtgaaccttctggccagtactggaaaggggaatgctatttatttttatattgtgtatattttgtcgtggtctgctgattccctgtttcactgagagcgacacttacctcaatagttagttcaatattgtgtgttggataattttttaaaagaactttttaaaaagctttttgatccttggaggtctgtagatttatttccatatgaactggttattttgtataaagtacatgcttaaaat

SEQ ID NO: 521 - DNA, 1931 bp, Homo sapiens
aggaggccgggaacatggcggggcagcccgcggccaccggctcgccgtctgccgacaaggacggaatggagcccaacgtcgtggctcggatctcgcagtgggcagacgaccacctgcgcctagtccggggacacggtattcctctctggcccaagctggagtgcagtggcacgatcatagctcactgctgctgctccacccacttcggccgaaaagatcctcccacttcagcctcccgagtagctggaaccacagaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttgaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgctttatgtcc

SEQ ID NO: 522 - DNA, 1818 bp, Homo sapiens
ggaaacgcggcgcggccggctgccggaaaacagggcagacctgtatgattggtttattcctggggttgtcatatcatggctgataatgacacagacagaaaccagactgagaagctcctaaaaagagtacgagaactggagcaagaggtgcaaagacttaaaaaggaacaggccaaaaataaggaggactcaaacattagagaaaattcatcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggaccttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagagaatactaatttggagacaccaacgaagagggtctgtgttgacacagaaattaaaagcatcatttaaccatagacaatttgccaggatctaggaaccacctaatggtaggtggacagaaaaggaaaaaaaaaaaatttacttgcaagtactaggaattcagatgatcagctcttaaaaaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagt

SEQ ID NO: 523 - DNA, 1703 bp, Homo sapiens
gcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatg

SEQ ID NO: 524 - DNA, 1500 bp, Homo sapiens
gttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcagtccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcggaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacctcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacttttccacgacagacttaactgtataatttcgttgtaaaatctgtaagttgtaaatattgtacatagttaaatctgtattctgttttgaatttttttaattaatagaaagaccaaccggcaaactttc

SEQ ID NO: 525 - DNA, 2635 bp, Homo sapiens
aacaacaaaaccggcgcgccagcggtggcgcaacggctctcgtccccgccctcctgctacctgtagtcgcctgggccgcccccggcccagccctgccttgccgccaccctgcgctgtccagactgaggggtcaggcggagagccgggccgcgcccttcggtcagcttctctccctttcacccgcgcctcctcgcgagacccggggctgggccgtgccggtcgccgcgcagcaggaagggagcggctgccacggaaaacgcctggccggacggtgtggctggcggccctgcctgggcgcggagggcggcggtggcgggccccgcggccttctctcaggtaccccagtgcccgctgaccgccctgagcggcccagctgcttccccgatccgcaccgcggggccgtggcgtaggggccttgttgcgttccagcttgggggtcgcggtggggcggggcagtgaccccgggccggccgttgtgccctcatccctcccacccttccttcgtatagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagtttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtagtcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcag

SEQ ID NO: 526 - DNA, 2324 bp, Homo sapiens
agttttcaaggcgggctgtaactggtggcatttgtcccgggaccagtatgccttgtaatttttcactgaaagctggacatgatgtaccctgtgagaggaactgaggggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcagaaagcgccgcccttggtgggccgctgggtgccctttgccgctgtggctgcggctaactgtgtcaatatccccatgatgcgacagcatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagcggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacac

SEQ ID NO: 527 - DNA, 2252 bp, Homo sapiens
cagaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtc

SEQ ID NO: 528 - DNA, 1816 bp, Homo sapiens
ctgtaaattaccataggaagtcttccaggaaacagggaactattaattgggcattaccacaggcagtgaaaattcctagttatatcctcaaatgctaatggtttcttgttaagtctgttccctcctgcacatgctagagactaatgaaatttcaccaccaaccatcccttcacccttgcctctccctcttgccattctagtgtctcatgatctttaccccagtgccaactgagaataactctacagggccaaccaacaatttctgtcaatctcttctttacaaagatgggctgattccccagtctgggaataatccaagctcttgattttcttcccttcactatttctgaattattccactgccacttccattacccctacaaaggctactgaaaaaatactaatgagcacctgtgttatatgcatgtaaaagcactattacttcaaagtatcactacgaatctcaagggataatctgccaatcaaactatacaagacacttttttaaccgccccccccgccaaactaaaatcaccaaaggaatcctaaacaacagagctgtcccggccaaacagacacagctgaaggcagagagccaaccattagacaaagctgaagtctgcaacttctgattttcttactttagagtgaactaagtgactagaaattggcctgaagtttattcctgctaaataatttccttaatgacaacatttatggagcacttaacaaatgtcaggtatactaaaaactttacttgggttatctcctttaatgatcaccaaaacacaataaagttggcattattcccatttttacagataggaaaacaagcttggataggtaagaaagaaagaaaaaaacttgccaagctgtcacagttcattaatagagtctgtatcacagtctaggtaggaatgactctgatgcccttaccttttcaaactaaactaagctttgtcaccttcattgagtttgattattttaagacttttattactaattctggaatcacagacacacccccccccccattaagtcacagtcaggtgctggacagcacgggagaccctgagaaactaccatattgggattaattcctggactcaatgtatgggatccctttcctccctcaaaacacactttcccccatgcccccgtcataaattcattcttatgctaatattgcaaagcctccggtaccatgcttcttaccgtgatattcttgatgatctgctgcaccaagatcgcattggtcaacatatgagtcctgaggggtgcatgctgaagcagcagtcgaagcagctggcccacaacaggcagctcctcaggcccaactctgttcacccgcaggctctgcagcatcaacctgaggactcgaggcaagagagccaggatggagacacagaccccccacagcttgtccctacaataacagagacagaaatgagtcagtgagcaaatgcccacaggaaaagccccccttctatattcccccaaagtgaaatgtccttttaaggaacatgttttccaataacatttaaactgagagccaaatcaagaacgcaatctcacttacaatagccacacacacacactaaatacctaggaatacatctaaccaaggaggtgaaagatctctacaagaaaaactacagaacactgctgagagaaatcacagatgacacagataaatggaaaaacattccatgctcatgaattggaataatcagtattgttaaaatggccacactgctcaaagcaacctacagattcaactgtattcctatcaaactaccaacatcattcttcacac

SEQ ID NO: 529 - DNA, 2279 bp, Homo sapiens
aactttgattaggaattggatggtgagttgggatcccccagtccttagctttttgctggagttctgtaaatctcaaaatgtcagccacaggccatttcttttggtttatttaagtgtagattttttaaaaaatcactttttccacttcatggctcctttggaccagggtataaaaatagcgatgccaccaggagccaagctctttctggaataatgaagcaggcgaggacggagccttgctcaggacgacagaaggcttgcagcctgcctcaaacgcaactctaatttcagccacttcacttcttccccccgcgctcagacttgcctcaaaggaaggagccgtttatgagacactccgtggcgcgcccaacacggttacccaggcgcctatcacccttctgggacccggccacctgtaagaacctggagggcggagcgggcgaggttgttcggggaagggatccccggcggctgaggacatccaggagcaccgagattcttggggagggcctcgccgggcccagcgcaggagccgccgcgcgtccagcggctccaccgccgcagcctcgggaaccgggcgccccaggtctcaggcgcgccccgccgcggacgcgaatggactcgtccggcctcggcccctgcagcgaagctccgcttcacaccagcgctgggctgtccggccgcaacctgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatttccaccttctaagccgaaatcaccccgggggagggtccgagctcggagcagcgacggccggctccgccacccggcctggcgcgcaggcagcggcgggcgaggagggcgtgggcccagcgcggaactggcctcccgatactggggcagacggcgcgctctgcccggggccgccgacctccggccgaagggagcgcgggcggacgacaggcgaccactgcgcgcaggccggaagctccatctgcccgaagctgcgaggctgccagggaatgtaggcaagtcgggggagccccacaaagctggcgaggtcgggaatcaccccagggattcgtaaggctaggtgttattaagggttgacaccattctcgaagaaggcagccaaaaaaaaagacaaaaaagttagtggaatctatcaggattcaaatcaacttttgcaagcaatatgcccatcatccttcctgagacactaaataaatataatggattcatccaaggaataaacattatgagttctcaaaaaatgttttcgtcacaacctggcgtgaatgcttttctccggagaaacactgaaggcggcgttcttgcgattcaagggtacgctgcgtccaggtttatttcagtttcagactgaggtctgctaagaagcccggcctcaaactcaagataaaaacagaaaagtcccagtgttgacgggagtggaggagcccgtgttcgcttcaaggtgccggcgtgctgctctaacctgtgctatatatactcgagcactctccatataatgcctccatttaccaacttgctcttaaaaaataccaaagcaggccgggcgcggtctcacgcctgtgatcccagcactttgggaggccgaggcgggcgcatcacgaggtcaggagatcgagaccatcctggccaacgtggtgaaaccccgtctctactaaaatacaaaaaattagccgggcgtggtggcgcacgccttagtcccagctacttgggaggctgaggcaggggaatcacttgaacccgggaggcggagcttgcagtgaaccgagatctgccactgcactccagcctggcgacagagcaagtctccgtctaaaagaaaaaaaaaaaaaacaaccaaagcgaagtatttttggttcaaacctgcactatttaatatgatagccactagccacatgtggctattgaccactcggcattatggttagtctgaattgcccactgctggatgtgtaaaatgtacactggaatttaaagacagcgcagaaaacatcgtgtaaaatgtcttgttaatgattttcatgttgattgcatgttaaatgatactttggatataaaaaatatattattaaagttaatttcacctgtttgttttcccctttt

SEQ ID NO: 530 - DNA, 2442 bp, Homo sapiens
cccaactaccttagcacaataattatggtaattttgacagattgtagatttcaaatcatgggtcaggaaccgctcctgccagtcctgttgtcctgtcatcatctttgaggccagaacagcccagctgtgccaacatacctggggcgagaggcagcccatgttcctcacgccagcggtcagctgcgggttggcctcgggcctgtctctctcttgatctcgcccttactcactccctcgctgtctctctgaacctccttatcgctgtctgcctgtcttgcccacttctccttgttctcattgtgcctctagaccctctttaaagccagtggagtttgaggacatgcaatagtaattttataatcattactgggcagtgtaaaacaaacattagcacagctggcaaagagtgtaggcagatggttcctttgggatcctaaaaaagcaggatacagctgagatctctgtgacactgtggattcagaaactgctggaactgtccagtccctgtggtggctgccccttgtaggggtggtgccaagggtggcttgggggtttaggtcctcctaaatttccattaggccccaacaaatacacaatatagctaaaaaaaaaaaacccagtgtatttgttatgaaaatgcaactttgagatgagtctctagaccccacgtcccccctttggataaactctggtgcttcacagctgccggagacccatttgctgtcctctgctttgctaaccatcttcactgagtctttaatatcaagtggggctggaagactgaccagtgccctgattcatttacatattgattcactgcaggtctcaggcacaggttgataattatctaactgtttagattctaacacacattggatggcaatacaaagggcccatgaggcagggtccccttctcaaagaacttcagaggaaaagttaaatggcagtgcaggggttaactgataccatgttggcagcaacagatgttggcagtcagagatgactgtgctgtgtcaaaggcacacaggacaaatatgcacaaccaagctcctaggcaggagagatcctgtgggctgaagagaggtcaggctttgtggaagagtgaatttgccctggggccggaggatgagtaggagctggacagctgagcagggagggtgggggagggtgttccaggctgaggaccagcatggggtgtggctggcagaactagaagtgcagcatgggactatgtgatgagtgggcctagttgggaggtctgacggatatgctcagcccaggcattgggtgtgatgctgatgtcagggctgcccacaaacttaaacaaaagcctgggaacacaaacgtggtatacaccatactaaccaatgtgggaaagaaatcacacatggagccgcttctaagacacattcaataagagcagacatgggtgaccatcctgcgcttctatcctgtgggccagggcagcactcccaggagaaccagcatcttcatgtgccagggtccccttgggaggtgagtctgggcctctcctgtgatgggccagctgcagggtccttccacacgcaggtcctctgctgaaatgacgtggccttggttttgcaggagaacgaggatggtagaataggctggcctgggcaggtgtcccttttagtagtcctctgggtcagtctctctcaaggcctgttgatcctgacagaccccagacacctgtggtagcccagagatgaatgaggcctacttcaaacaatgccctaatgctgaggcttatctggcttctgtcccaccagaaaccaatcagttccaggaagagttttccagcctagcctgaaccctgccagtccaataacagcatagcccctgatgtgtagtgagcactcgataaatatttggctgatggaattcccaccctctatgtctctcacagctgagtgcctcccaaatccttgcccaagcagcctcaccctcttccccactctccagacctccacagaggacacaactgcaccatctctgtcgctattctcatcattgagacaccatccaccatgcatctccctccactctctccctaccccagctctccaggacccagcctaccacaattcccaacttgctggctggtcccactgtggcttcttgggaagtctgcaaggatggaaagcccatgtgagtacctaatggcggggggtactcagaaagaggagccgcagagttcttggtccacaacaggctagcagggaagagaaagctgcctgaaatctatcttaatgtacctctctctctctctctctctctctctctctttgtgtgtgtgtgtgtgtgtgtgtgtgtgtgtgtatacacacatacatggacatctaagtttatgaggcatctttgcatgaatatgtattgatatattttcatttattggcttaatggattttttctgcctttgtc

SEQ ID NO: 531 - DNA, 2861 bp, Homo sapiens
ccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtccctagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaattggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgcctcctcagggtgtcccagcaccagcctggcacagagtggggctcagttagagtatgtgggatgttggtttcgccgggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacctgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggctggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgtccccgacaagcccctgctggtgtctccatctcccgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgccgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtctt

SEQ ID NO: 532 - DNA, 1912 bp, Homo sapiens
gatgtttgggtgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctctcgggggaccttcgagacaaggctgtcagcccctagagtgcgctagatgttggaccgagtatggaatccgccatttcccctgcccgtcgccagagagcaagctgcagaacccctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcgctacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccgcaggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacctggcctgcaatggacccgagagcttcacagctgcctgctgtcctcccctgcactgaccccactcgcccctgtgtcggccccagctgagcacccgaataaaccgctgtggcttatccaaaaaaaaaaag

SEQ ID NO: 533 - DNA, 2708 bp, Homo sapiens
agattagcagggtgactttcaccctgcaacagtcacgctggagtactctggtgaaggatcaagaatattaccagttttctgatgaagaaaggaatatatttggtcaccagcaatctgcctttgaccatcctcaaagccaagtttttcatcgctgtctagaaaaatacttcattcagaggacacatatgtcctctttgaatgtctcctttttgggagcagtaggagaaagaaacttcaagatgtagaaagaattaatagtgtaacggaaagaaagaaggcaaaaggaagtaaatgtggaggccatagaaatagtaataagaataaagaagaaaaacaggaaagaagagggaaaagccatagaaaataacagccagagcgagtaggaggagacagagagaacgagagagagaaaagctgataaattcctgagaaaagtttctcttcttaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgttgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgctttcgatcacgacagcactctccagagcactatcacatctctgcagtcggtgtttggccctgcagctcggaggatcctggctgtggctcactcccacagctccctgggccagctgccctcctctttggacaccctcccagggtatgaagaagctcttcacatgagtcgcttcacagtagccatgtgcgggcagaaagcacctgatctacccccagtacctgaagaaaagcagctgcctccaacagagaaggagtcgactcgaatagttgactcttggaactgatgagagctgtcattttataaataggagtggagtgatgtccagagtctgtgggaaaatggaacacatattttctaaccctcagaagttttaagatggcatctaacaccatcattctatgggaaagatggttcttactcttcgttcacaggcctttatatcttccgatacagaatgctctaattgggaactctaattttgtatccaatggccaaaatctgcaagtaatctctagccacactgattactactaaaccaggaaagcatcaaggtatcttgaattcctttaactattgagtgcatatagaattcctgtacccacatgatactgcaagttgtgtctctctctgtcagctaatccactgcggttaactggaaaagaaagacaacagtgtcagcacagccatcgacattaatgcactgaatgcatgcatctttcctcctgagacagcaatcgattttacaccgaatgacaatgatcatcttagacagcacaacatacccactcggatatctaaaagctagggatggcattgctgatatgggcaaagagaacacagtatagtatttaagtgccaaatatcagtctttctttctctctggtcctacccctcagcagtatgaaaaactccatactgtgcagtcacagttggattaattcttcagttcctccgcactgcaaacacatatatgtgcgcacatgcatgtatacctgcaccctgttttaactctaaaggaatagtgttgctttacttctttcctgttttgcctggaccacttaaagccacaacacctctatagtgacacacgctagtctctagtggtggccctcactgccacctagaggagccatggtggaaaacacactctctcctttgagcctatctgcacatctctcgagttcttggagcaaaaactaaatgctgaactaagcctggttgagatgcttcccatggaccatgccgcagcacagtgctaatctatccacaaaacataccacctcccaaagtattattattggaaaatcgaggaagtgacgcacatttagggaaaaactactcaccttagaaaagtcactgaaatccttttttttttttttgagatggagttttgctcttgtagcccaggctgggatgcaatggcatggtctcagctcactgtaacctccacctcccggattcaagcaattcttctgcctcagcttcccgactagctgggattacagctgcctgccaccgtgcccagctaatttttgtatttttagtggagagggggtttcaccatgttggccagtctggtctagaactcctgacgtcaggtgatccgcccaccttggcctcccaaagtgctggaattagaggcctgaccccctgctcctggcctgaaatctttaaagccgttttttccctaaaaaacgggaaataataacacctcagaaggtttttgtgaagatcaaagaagctaaatatatgtggcatgatttgtaaagtgttatgcatatgtatgttattcttcctactgtcttctaaccttcccttgcctgctatgacttatctgagagccatgttcccatttatctttttgccaactatgttactgttgtcacacctgaaatggctttgtttttatcaataaatacttgttgattgtggtaaacagc

SEQ ID NO: 534 - DNA, 2140 bp, Homo sapiens
gttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccaggtatggtcaattttgtgatccagccatccatacaggatgggatgggatggctgcaaatgcctgggggtattctgcctcctcatctccattcccaccccctcagcacacaggcacatgtgagtgcacaagtgtgtgcacacagatacacacagatttagaatacaaagaaaccactgctgtggcttcatagccccccagagcccttggactaatgtaagtaacagttctaccggagttgctccagggaatagatacgggacagaaagatgctcttctattgctcttgggtgataattgctcagttgggagaggccaagagtctctgggtcaggttgtgtttggccccatacttgtgtcctctgtaggtgaccatcatgacacatggaagcttgggctcagtctccctaaagttgattgagcctgctccttatctgtgaaatgagggtggttggccttgatgatcttgcagtaagatgtcctgatatgggaagtgcagtcccaagctaagtgtgctggaaaggggaagggacctgtgtggataagctccccatggtctggactgattttgtcttttctgaatagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgcagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagc

SEQ ID NO: 535 - DNA, 2221 bp, Homo sapiens
aaactctgacctcttactctctctacttaactctggtcccgggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctgtacgtgagtcctgagaggcgtgggatggtgcccagtgggggtgtatggggggactaggggagggcagaactgctggtcctatcagattcagcagcgactggaatagggacatattttatatttggaatccaagacttttccttgattcatctggtctccttgaatttcacactgttttctgctgtcccccaaggtcacttcctattccttccatgggagtttccttctctggtatcaccccccgctcttatgatattctgcccactcccacctcctttcccatccctcaggatacccactgcctcttgctcctaaagccttctgtctcctagggttatcctgctcatggtggtctgttctcagcacctgggctcctgccagtttcatgtgtgcccctggaggcgagcttcaacgtcatcaactcacactcctctccctgtcttccggctcctttcggtatgtgtgggtctgggcagggcagtagaggtcagaagggctggcctggagtgctcactccatcccctaccttttggcttctgtctacccctgcaaggctggctcagaaggttctgggggaggagttcttttctcagtctcgcccctcaggtgctgatcccagtggcctgtgtgtggattgtttctgcctttgtgggattcagtgttatcccccaggaactgtctgcccccaccaaggcaccatggatttggctgcctcacccaggtgagtggaattggcctttgctgacgcccagagctctggctgcaggcatctccatggccttggcagcctccaccagttccctgggctgctatgccctgtgtggccggctgctgcatttgcctcccccacctccacatgcctgcagtcgagggctgagcctggaggggctgggcagtgtgctggccgggctgctgggaagccccatgggcactgcatccagcttccccaacgtgggcaaagtgggtcttatccaggtacgtggacctgggatgggagtggggtaggatggagctagaggggaagaagaaggacaggaacttacaccgattgattgccaggtgtgcctagcacctcacatcaactatcttacttggggaggtgcctaagattagactttgggctaagagagtggggaagtgaacaaatcaccacggaactcctgtgcatgaggcactgtatcaaggctagggcaaagaaccagtcacataaagttctgctctcttggggacttcatagagggagaggcagacagttgaaggaaaaaagtatctttttaaaaaagtgggccaggcatggtggctcacacctgtaatcctagcacgtggggaggctgaggcaggcagatcacttaggctaggaattcaagaccagcctggccaacatggtgaaaccctgtctctactaaaaatacaaaaattagctgggcatggtgttgtgcacctataattccagctactcaggaggctgaggcaggagaatcgcttgagcctgggaggcagaggttgctgtgagccgagaccgcaccactgcactccagcctgggcgacagagcgagactccatctc

SEQ ID NO: 536 - DNA, 1830 bp, Homo sapiens
cttagacattaatggagctgaatcttcaattatcagaaagttttaactcatatattctagagaattccaaatgaattaagtgctcactgtgtccctctctaaattcattctcttggtctccttgaaaaaagaagacgctgactttcaaatgaccttttaaaaaccctctcctccattctcaccagacagatgaaactaccgaactcctaaaattcttaagaagaggaaaccctggccatttttagctgcttaataacatccacgttgtccaaagaactctttctttagtctcaccaatttcttttattctactgttttctaatctcagaaaataatcaatgtttgcatcttttttccagaagtcatggtatagagtaataagtcctcttttcacccacagtggaaactgttctacagactgttgttaaaattgctagtgttactgtcatgataatgatgataatgatgatctaacttttttatatactttgaaagggctgatgctattattataggtcttcttggtctggtcttttgcagggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaaacagtcaagaagttgggacctacatgttactaaagtttgctaagctgcgggatgaatttgaaattgttggagacgtccgaggcaaaggcctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcattagaagtatttcgttctgccttaacccaacacatggaaagaagagctaagtaacattgtcagaaataaataaaaccacaagtctcaagaatttgccacttatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctctgatatttgaggtaataaattcattgttctgt

SEQ ID NO: 537 - DNA, 3055 bp, Homo sapiens
gcatatccaggctctccagggtcaccagctgtgctccacacacagggaagattgatggtggcttgctatacattaatttactggttgtttgtaggtaccagttacattcagggatgtgactgtgatcttcacagaagcagaatggaagagactgagtccagagcagaggaatctatacaaagaagtgatgctggagaattacaggaatcttctctcattggcagaaccaaagccagaaatctacacttgttcctcctgccttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatctgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagcttttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcggccttgagcatgcacaaaaggacacacttaggagagaagtttatgtgtagggactgtgggaaggctttagcaataatcaacatttaccagacatccaatgacagcctcaggggaaagcacccttgtctggggagtgttggggagcatcagtaaaagaatggacactcaggcacagagtggccctcaggaaggaggtctttgtttgtaggatgtatgggcaaagcttttgtgatcacacaccacagggagaatctgcatgtggggacactgtggagctctgcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgccctcactccccagtgaatcctcaattttctgtctcgttgtctgtccagataattgattctaagacatgttaggtatataaggagtgtagataaggcttcagccatgagtcaccccccagtaagccccagagtatattgaatagaaattctgcatgtgtggggagaatggacaaggacttaggaaaaagtcctcatcaaagaacagcttttttgggacaagctttacatgggtggggagggaaaatgtgaaacacattagcaataagttaaacctcatcttgtactaaaggaggacacactcagggagaagacctctgtgggcagggcttgtgggtggagcttcatcccgatgtcactcctcaactgacttagggggacagtcttgctaccccaagtcactacctcactcacctctgagggattttcaggaaatgtcttgactcccccatgtactctgtatgtgagcgaagatggcagtaactgttaaataagcattcttttctacttcttggaatcagatgaaataaaaaagcaggctttatttaagtaatc

SEQ ID NO: 538 - DNA, 2290 bp, Homo sapiens
agaaccagacgagctccagctcccaggctaggtgggtgccagctcctctcaggttggaggctgggcagggtggggtggggtggggtggggactggtagcccaggggtccagggcccggatggctggatgcacagctggggcagaggcaggagccatgccaggactgcagcctgtaagccgggcacaggtgtctgaggggaacattgcagagacgcagcctccaggttcccagccttccaggcagccttagagagtcgggggcccccccacagcggggtctgggcagccaccgccctgcctccccttcctcgctgagccacggggtgccttgtgttccctccaacctggcagggaggctggggcaggggggcctgatccagatacccggcccctgggctgtggggaggagggtggaaggaggcccatcagcaacacacagaggctcccatcccagggacggcacagtccagtggcaatatttctccagggaccccaagcctggctgggacaggggccgtgccttgggcctaagatgagagagctcttctgaagggagggaggagggtggtaaccaaacccagcccccgcctgccctgcatggcccctgtgacattcccaattgctggggactgactcacccccacttcaaaggccttaaatagttcagctatttcacctgccacactgtgctgtcactctggaattctgctgtgggggagctgaggccccacctgcagacctgctgctcacctgggcaggtgcctcctcacagcccatctgcacagctggcctgcggagtcctcctcaggggccactggccctcatctgccactgtcgaagggatgcctgcccctgctctccccacctcagccatggctgtgcaggtgcccctgtggcaccactacctgcaggccatccggtcccgggaggcgccgcgtgcccaggacttccagcgcgcagagaacgtgctgctcacggtgctggagcgcgtgcatgccctggacccccgcttcatcgtggactactcccgtggcctggaggccttccagttcgccctgcgctcctctgaggacccaatggacatggaggtgcccctgtgggtggatgccgaggctctactgattgaggaaccagaggccacccagccggaggatggccttgaattatgccacctgggtgtgcccagggaaggggctggcctggagcggtggaccaccgaggataccttcactgcctcctcggagggtgacgccaagtgccgtggacacattgtgcccagcaaggtcctgtgtgtcctcaaggacctgctggtggcagccatcgtacactgcaagcaccacagtctcatcgcaccaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcaacttgagaagaatcctcagccaaggggtggacctggtgccggccagtgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcccggcgcccgaggactgggcagagctgcagggcgccgtgtaccgcctgctggtggtgctgctctgttgcctggccacgcggaagctgccccccgccgcgcatcggctccgggctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgatgaaatgctgtatatttggttttgaaaaaatgaatgtgctgggtatacacagcagaaaggg

SEQ ID NO: 539 - DNA, 2910 bp, Homo sapiens
attttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcaggtttagctgagggggttgaggtgtccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgttctgtggtttcctgcagtcacccgcgcgttttcaacacagcgcatggagggcatctacacacatacacatccctctccatcccctcaactctggagcaaacactcaaagtcaagtatactggttggagaaatgggtaatagttacttatctttaacatttattttacaaacaacctattccttttctcgtcatggtacacacttggtattgtttgggttttttttggttttgttgttgttgttagtgtgtgggcgtggttttgtttgtttttggagacaaggtctcgctctgtcgcccagggctggagtgcagtggcgcgatcatggctcactgaagcctcgacttacagggcccaagcgatcctcctgcctcaacctcccggatagctgggattacaggcgtgcaccaccacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctcccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggttagtacttcctcagcctgtgtctggcagctggcttaccctccagtttggcccaacctccctgctgtccctattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctg

SEQ ID NO: 540 - DNA, 2516 bp, Homo sapiens
attaaagtcttcagtctccacattccctactttccaaattcagctttcccgggaggtctggagcagctgcctctctggggagatgctggaggtctcggaatcacctcacacggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgaagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccatcagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcacgctctgaagcccatggcccagtccatctacctggctgggattctggtgggagctgctgcgtgcggccctgcctcagacagtgatggagtggacggcggcacgggcccgacccttggtgatgaccttgaactctctgggcttcagcttcggccatggcctgacagctgcagtggcctacggtgtgcgggactggacactgctgcagctggtggtctcggtccccttcttcctctgctttttgtactcctggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcggggctctgcattctggccaacacgctggtgccccacgaaatgggggctctgcgctcagccatggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgctcgacaccatccaagatgtgcagaaccaggcagtaaagaagacaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccaggggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccgccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatg

SEQ ID NO: 541 - DNA, 3029 bp, Homo sapiens
cagggggcactttcggcttctgcgtggcctctgggaatgggcgcccagactcaggtatgccctctcctcttcctcagccccatggctggggcggccttagcaaacaaggcagggccttctggctgtggtcagaggcttttctggtctttggctgagccgtgcagctctgggaattcagaaagcctctgactacaggactaggcttctcccctcaggggctctttctgaattgtccagggctctctaggagtctgcacctgcagagcctttgccctaggcaactgcagctgagagtgcgttggtggggagtgtgcgggagggggtagagttggcaggtttgactccactgtccccctgctgtctgatgacatcttgaaattagaagcttaggccgggcgcagtggctcatgcctgtaatcccagaactttgggaggccgaggcgcctggatcacctgaggtcaggagttcgagaccagtctggcccacatggtgaaacccatgtctactaaaaatacaaaattagctgggcgtggtggcgcatgcctataatcccagctacttgggaggctgaggcaggagaattgcttgaacccgggaggtagaggttgcagtgagccgagattgcgccattgcactccagcctgggcaacaagagcaaaacttcatctcaaaggaaaaaaaaaagaaataaataaattagaattttgaaggccatctttgcagaggagagccagagggaaactgtctgtgcctgctggttctcagcagtccctttgatgtggctgcgttgaaacggttcctttcctccggctgtggagtatgtctgggcacgtggagcatgcctgtctgtctctgcatcccgtccctccctcaggcctgtgcccgatgattatgttcagatgaatcctggctgcaggcctctgactggggtgtgctctgggtctcaattcaacccaggcaatggcagggagaagtcctggacatcattctgcactctgaccagttctcagttccaccccatccacgagtctttcagggcaacgtgacctgcaaaagcccacgcccaaggtctgtggtccagaatgcatctcaagggcccataaaagacattccccagaggatcagggaaggaagacacgtatgtgagggtggggaaggaggggaggggaaggaaggagagagaaagggagagacagatacagaaagacgaacacagaagcctgctgcggccgggctctgccgatggggggttgagtcctgtgctttgatctcctagctcaatgctgtttagcctggaaaaaagtctgcctgccaccacatttgcagaccacagcatgagttctcatgtctgttccatcattgtttcaacaaatatatactaagcacctactatgtgttatagatacgggggatacagcagtaaatggaacagaccaaatccctatcctcatgaatatactacccagtgagcagttagattgtatctataaaatgtgtactcttgttatgtataatgtgctacgtatgtcagatggtgaaaagaaagttctgagaaacagacagataaagcaggtgtggcaggtgctggtatagacaggagtgtggggaggcttttctgagaagatgacacttgagcagggccgtggatggggcgaggaaggggccccatgggtgtctggggaagagcattccggcagactgaacagcaagtgcggagccctggtggaggggcgagcctggcctgtgagaactgtgagggtcaggctggacactgcagagcaggcaacgggttgggaggagcagagtttggaaagatggggttgtgccactgtagggggctttggctttcatgccgaatgagatgggagccactagagggctcggagcgagcactgagactctctaatgtctatgagaatagaccccagtgggacacgggtggagccagggagccctgtgttgaagctatttcagcagtccaggacagagacagtggtgcctggactgggaacggctgtggagatggggagaggggagaggggacaggggttggattctggttgatttgactatttgctgatgagctggacatgtaagaggaagagaggacaggtctctgcctactctggacctcaggaggataaaaagtccttcctcacaggccttcccgtagcctcctctcccgttaggggagcaggacaggccccccggacaggtggtgtgaaggcagaggcagacaacgcagcatgtttgtgctccggcacctctgctggctatgtgatctagagcaggcgacatccccactgagcctcactcagttccctaatctgtgaaatgaggatgacaaaacctacctagaagagtcataaggagcatttggtaaggcacacaggaaagggcctagcatttttcttccctccccttcagaaagagaaagtctggggaagagaaccccagacagggaccagcgtgatccgcattcacctgtcgatgtgagtgcacacacaacaggtcattgtactctgccgcccaccctcccccagagtccctttttgctcccttgtaggcagtgggagcccctccctgtcacccgtcagggagctctgatgggcaggggtctctagtgacccagggcccccggcaccctcgcctgagttggtgccagctccccgttgtgcccaggcactccctggtcctgctgccatcatgggcgctggatggcacacaggggtccccacgcacatgaagcctggcgagtgctggggcctccgtgtcccaggccatcctccaacagcagagggtcgcttcttccaggctccaaggggctgtgaggagggctggcttgcgccccgcactgaaccggcaggatgctggtattaacttgctggctttcacatccgactctatatgagcctgtgagaacagcaggctttgccttctgcttctaattggatacaacatagagatcacacatcctcaacaaaggccatttccagcagacaataaatgcctatgacagcaggctgtc

SEQ ID NO: 542 - DNA, 1960 bp, Homo sapiens
taggaaatgctgctgtaatccaaatgcttcatttgaaaataatacaaaacaaaaaaacccaggttaataagcattcacagatggtagcatgattagaactgggattcttttctcattgactgccaatccatttgtgttttcactatactgtgtatcttggggatgctgaagtttcttttttttttcttttttttttttttttttgagatggagtctcactctgtcgcccacgctggagtgcagtggcacgatctcagctcactgcaacctccacctccggggttcaagagattctcctgcctcagcctcctgagtagctgggattacaggtgcgcgccaccacacccggctaatttttgtatttttagtagagacagggtttctccatgttgctcaggctggtctcaaactcctgaccttgtgatccgcctgcctcggcctcccaaagtgctgggattacaggcgtgagccaccacgcccagccagggatgctgaagtttcataagaaaagtgatcttgctattgggaaagggaagaagattggaaaacagtgtcataggatagtggtagttgagcccaggagtgggaaactactaaaaaaggcctgttatggatcagctttggggataaagcaaaacagcataaccaatacgaataaatgcattgtccacaaccaccagaagatagaagcattgctgacagtcatacgtattgttcgtgttggccttccctgttctttgaagtggaagaagagaaagggtgtctgaaacctaaaccaggtctcagtgaatgatgtcagttctcttaggctggtcctgaaagacacactcctctaccaaagtagcttcaattccacagagaacagaattggagatgacaagggagaaaactagaaagcaggtaaagcatagtcacaacagtagccatagtccagacaatacttctttgagttagatgtcatcagaaagcagaccagactgggaacacagtgcccacacctgggtctctgagcttaggtgtcttacagttctttcctcacttttctgtctttggtctcatcccacccaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaaccc

SEQ ID NO: 543 - DNA, 2095 bp, Homo sapiens
aaatttacagacagtgggagtagctcaccgttacccaagtatgcttcatctcccaaaccaaacaacagctacatgttcaaacgggagcccccagagggatgtgagcgagtgaaggtctttgaggaaatggcgtaagtaatgtcttttttgtcagctgggatctgcaaagctgtaaagctttttactgagaccagttgattacatatgaatcaactactctatccagctgataatgtgtttcaagagcaaattatgtaaagagaattgaataggcaagagagatcttactgaaggagaactggagtctgtatgttggaaatgtataagccagtacaaagacacgtggaaacttattcttactacctgaaagatctatttttaaccattaagaattgtcatttcaggaactcttagttagatggtaacaaagagactttaggagcaaagttaatatccgtgtgtgactagcttaaagacagtgtactccacaagccagaagattagtctccttccctgtagcctcatctagcttacttattcagactttctgttcacaaggggtttgttatcttcatgaaattttaatatgtgtaagttagaaatgaaattagaaaaagaggttcttgctgtaaacactgggcagagtagctcagaagaagactgtggttcttggatgccctcatgcctttgttccagtgcaggtgcctagtggagggtgcagtgctcttgcaacatagaaggacccatcttgcaggagctgatggcttagctcctgggaacgggaggagaggaagggcttgtggacccaacctctgttgaattgactggctttttgagagaccactgaaactctcccctccccactccaccccccatctgtgctagcggaagtctatctagaaagaaaaaaggagaaagtgtttaaatacgtgatggacgaatgccccctgcctctggtatactttttcttaacagaaaaggtcattctaactttgcataatcttcaattataatgcagaagacttttccaccttcctaaataattaaaagcaaactaatgatctctaaatatttgccttcctggttcttttgaaaatccttttgtctcaaataccacttcagtgctgtgtgcatgaatagtctgccagctgacttgtgctatggaagatgtttacccctctgtatacacttaacccatctcctgccatttacattttagctgttttagagaactccagttaattcagaaaatgcttaactttttctgtgttcatgattataaatctaattttgttttatggttttaggtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactctcctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctgtgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattgatccaggtgtttgtttctaacttctgtaatacatacaatgc

SEQ ID NO: 544 - DNA, 2493 bp, Homo sapiens
agtgccaccgccgggagccccgggtctcggcttcagccccgggctgaacaagcagggaggggagaggcacttaggcctcgcctccccgcggccttcctcccccagccggggcggaggagacccaggaagctgggcccggctcccgggggtggagggcctaggcctcggcccgcccgaggcggagcccgggaggtcggggcggggtcccgggccggtcacccacctgggttgccagtcattccagctccgcgaatagttggtgccgttggtgccaccgccgccgctcagccgagaccccggggctctgcggctcattaccttccccgacacgacatggccaagcgccgccgcccagagaagcgcgagtcgccgcccgaaccggccgccgccaacaccccgctccggcccggggctgaggaggaagccgagaaggaggagaaggaggaggcggcggcgggcgggggaagaggacgaccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagaggtgaggtctgtgcagaccctgggtgaggggcgagttggctatggcctgtttaactccacctgtgcagactgcagctcagcctcgtccatgcttcgtgactcagccttgtcctcagggaagctggggctggtgcaactttcagaagtggtcccagtgccgttggtggttgcctgacgaaaagctgcacttaatagaaatcactgtggatgcaggagatggacggtgatgagctcaggaccagccagcaaccccatcaggcggtaatgcctaccatggtcacccatgacttcctctcgccactgctcggagctcctgcaaagccacaggcaacaacacatttctgctccgtacgagaagctcctattgtaagtcggtgacatggctggggttttctctcagcaaatattgagcaaacactgactgtgccaggtgatgtgctgggtcccaaacccttcccagacccagccctggcactcacggagatccagctaggaagtccgggaaaaggtcatcggggaaataaacaaagtcaagcacagtggatgaacgcgctgctgccgctccccacacctcttgtggtggacatcacttacgcttcctcatggtgcatgtcacttatgcttcctggtgccctcccagatgacccccccttgggccactacacacagctgcacccggcaagagcagacaaggatggtctactcactgagcctgcaaggctggtgtgcaggacaggccagctacactccccaggtgtgtgcaagaccggggacgagtcagtcattgggaggtgaggtgctcgggcagtgtgggatggaggaggagggagggaaactgagtgtgggctcttcgtattggagaggaggggacggccatggcacaaagactcagatgggaaagtgtgagaaagcagagatttcaaaggagctacggtggagacccacagaagaggaatgctgaggcttttctgtctgaaatgctgaatagactctagcacacgcaaaacagcccaccacagcgagctgcaggattcttccgggcttttaacagtggtcttgtaaaaaaaattagccgggcatggttgtcccagctactcaggaggcagagaggggaggatggcttgcgcccaggaggttgaggctgcagtgagccatgatcgcaccactgcactccagcctgggtgacagaatgagacccctgactc

SEQ ID NO: 545 - DNA, 3757 bp, Homo sapiens
agctgggagaaaaaagccttggagctcccccaccctctaacctataacctcatttctgggaccccagtggggcttagttgggggcaggttcgcatgatagtctgtgtctccgcagcggccattctccacttttcgggtggagagctgatggtgaccggtccctttgctacagctggcatttttgccacctaccttcctgatcacatgacattgtggcggggcttcctgaatgaggtcagtggtccaggatgagtacccctccccctgccctccacccctcaggacagagccagcagggagtccctccagatagacaggacaagaactctggatggagactgtactgagacgtctctctgctggtgggcttgggtctgggccactgccgatgtcctgtggcttggggaggggcccaggtgagctgccacagcatctgctcctcaggagtggctgaccaggatgctccagctgtgtctcttcaccatcacggaccaggagaacaacccagcactgccaggaacacacgcgctggtgataagcatcctcgtggtcatcatcagggtgtcccatggcataaacacaggatatgccatcaatccatcccgggacccgccccccagcatcttcaccttcattgctggctggggcaaacaggtcttcaggtactgcccctgcccaggcccattcctttgagtttttctgtggagctcctgtgtgttgaggggtggggggtgatgtgaggggcagcacaggagggtcctgcagagcccccaggtggcctggggagcaggagtgagtcccaacatttccccaggccagtacagatacagatcctgcacctgcactgagtatcaaccctgtccctgaatcgggctgaggctgaccagggccctgggttgggggtgtttcctggggtagcctggggatgactcctctgctcaaccagtcttcgcccaaggtggatgagggtgctgtcctgggcatcagccccctcagcaggcctctgcctcttgcctgcagcgatggggagaactggtggtgggtgccagtggtggcaccacttctgggtgcctctctaggtggcatcatctacctggtcttcattggctccaccatcccacgggagcccctgaaattggaggactctgtggcgtatgaagaccacgggataaccgtattgcccaagatgggatctcatgaacccatgatctctcccctcaccctcatctccgtgagccttgccaacagatcttcagtccactctgccccacccttacatgaatccatggccctagagcacttctaagcagagattatttgtgatcccatcccttccccaataaagcaaagcttgtcccacagcagtacccccacttcctgggggcctcctgtggttgggcttccctcctgggttcttccaggagctctagggctatgtcttagcccaaggtgtagaggtgaggtgcctcaagtctttcatgccctgggaactggggtgccccagggggagaatggggaagagctgacctgcgccctcagtaggaacaaggtgagatgaaagaatgacagaaacagaatgagggattttcaggcaagggggaaggaagggcggttttggtgaaaggaccgtagctgactggtggggggctggctttggaaataatttgaggggatcctgagattggactctagactctcccctggttcttcccttccccgagttctggccggttcttggaccagacaaggcaaggcccaagaaggtagatcagaattttttagccttttttcattagtgccttccctagtattcttctagattttttttttcttaatcacatgaaattttaataccacagatatactatatatctgtttatgttctgtatatgttctgtgctttatacgtaaaaaagagtaagattttttttcacctccccttttaagaatcagttttaattccattgagaatgcttgttatagattgaaggctggtaaggggttgggctcctctttcttcttcctggtgccagagtgctcccacatgaaggaataggaaaggaagatgcaaagagggaaatccttcgaacacatgaagacacaggaagaggcctcataggcctccaagggctccagggaagcagctgcagaggttgggtggggtggggggccaggatccactgaccctggggccaggcaggaaacactctattgcctggggctcagaaggcagcatcacccatggttcctgtcattgctcatgcattttgcctttcaacaattattgtgcacctactgtgtgcaggccctgtctggacactggggatgcgcagtggatgcactgggctctgcctttgagggctgcagtttaatgggcgacaggtaattataaggaagaaggtgagtgcagagtgggaggcttggaggcagtggggcttggggtgggagagctcacatccagcctctgagccaaggccaggaggcttcccagaggaggagacagagcagggtattgtggtggggggtgtcctttttggggctgggtgctgcactttacagtttgaggggatgggcagaggaggctgggcttcgttctggaggtggggacatggtaaggtgaggtttagaaagcacacctgagccacagtgtgtaggatgctggaaatggtggagatgggcctgcaaagagagtgctgggaagtgatgacccaggagcagcagccaggcacctaacaatgggtcagcaccatgggcgtggagacgagggccgggattgatcaatacccgagaagtacaatgtacaggacttgggttccatttggatggagtgggtgagggagagggaggagtcagaaatggcttccagtttccagcttgggcctggggattagagatgtccccactgagagtagggcacaagtgaggaaatggtttggagagaaagatgataagttacatcatggatgtgctgagtctgagttgcctatgggacttggaatggggggtggaaaaaggtgtgtgatcttgagcaagatattcaactcttctgggccttggtcttctcatttgtaaaatgatgataagaatattacttcccatttgtgttgctgtgaatattaagtgcgctaccacatgtaaaatgttgagaatcgtttctagctcagagtaagtgctcaataaacacagttatgccttttatatggtctggagctcagaagtggaagacagggttttgtgaagtcatggctttgtggatgtagctagagtgtggagtaatgacaggagggtcgggggcacggcacaaggtaggtggtcaagagacactggacacaacccaaatgtccatccacaggggaacagatacatacactgctgtgcaattgcacatagtagaatcctctacaatagcaaaaattaaggcacaacagacacctgcaacaacacagaaaaattctggaggcataaaaagtaatacagtagctgggcgtggtggttcacacctgtaatcccagcactttgggaggccaaggtgggtggatcacgaggtcaagagatcgagaccatcctggccaacatggtgaaaccctgtctctactaaaaatacaataattagctgggtgttatggcacacaactgtagtcccagctattcgggaggttgaggcgggagaactgcttgaacctgggaggcggaggttgcagtgagccaagatcgcatcactgcattccagcctggtgacagagcaagactcggtcat

SEQ ID NO: 546 - DNA, 2626 bp, Homo sapiens
agcatttcctctccaggccgagatgagggctgagggcgtttggagggaagcgctctgcctactgccgggaggtgacacccgcgaggccgaccgtcccccgaagcccccgcaagtccagactgggggacctcggagatccacgagattgccagagaaggaaattgaggcccaagaagctgcatgacttagccaagttcacggagtagaacccgggattggagcccgggacattgaaatgaaggcgtcttgcattgcagctccgttgcagcgcagaggcgcaggaaggcagactaccacgagcctcgggctgcggcctcgccctcctggtcgagcctcctgccctccaaccctctgctcccgtttctccctctggttcatagcccgcgggacagagcagccctggattgggaggctcctcaggtctcaggctcaggtgcagaagcagagcccctaactggaaggctcggaggtgggccggtgaggcaagcaagccctgtggggggttgaggacagcttgggttggatgtccctcactgcagcctgtccgtggatgtctctgccttaagggaattggaggtggaaccatccagtcttgaaggtcaacggagcgtgaagagaggagcgtgcagcttgagcactacagataggagcgtcccttgctcctgccaggcagcccctccataggggcagtcctgtgctgctgtgcctcggtacccgcacaaggtgtctggggaccgcccggacccccccttccatcggcggcagcgccacctggcggccatggtgcggtggtgtgggaggagctgggcccgggctgggcactgagcccaccggagctgcaggcgtctgcagagccttgcaccgagtttccccgcgagggcgggcgggaggagtcccaggcgggaatgtgatccccagggggccgaggagggccctggggaggagcctggcctggggaagccggacttccgtgacacaacagacacaaaagacaaagtccatttggatggaagtgggagcagggcgagacgggccattttcactctgtggtcaaaggaaatgactggtctgactcggtctgggagcggggcacccagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgctctccagcctgggcaacaagagtgaaactccgtctc

SEQ ID NO: 547 - DNA, 2303 bp, Homo sapiens
agcttccagcacagcccgcggcccggtgccagctccgccggcgaccggtgtgccaaagtgcggtgctcccgcagggaacctggctcggggagggcctccaggtgagtgccgggctcggcgctctgctcctggagctcccgcgggactgcctggggacagggactgctgtggcgctcggccctccactgcggacctctcctgagtgggtgcgccgagtcatggagggcgcagagctggccgggaagatcctttccacctggctgacgctggttctcggcttcatccttttaccttcggtcttcggagtgtctctgggcatctccgagatctacatgaagatcctagtgaaaactttagagtgggccacaatacgaattgaaaaaggaaccccaaaggagtcgattcttaaaaactctgcttctgttggtattatccaaagagatgagtcacccatggaaaaagggctctctggtctacgaggaagggactttgagctgtctgacgtgttttatttctccaagaagggattggaagccattgtagaagatgaagtgacccagaggttttcctcagaggagctagtgtcatggaatctcctcacaagaaccaatgtaaatttccagtacatcagtctgcggctcactatggtgtgggtgctgggcgtcatagtgcgctattgtgtcctactgcctctgagggttaccttggctttcattgggatcagtttgctggttataggaactacactggttgggcagctgccagacagcagcctcaaaaactggctgagtgaactggtccatctgacttgctgccggatctgtgtgcgagccctctctggtaccattcattatcataacaagcaatacagaccccagaagggaggcatttgtgttgccaaccatacttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggctttttttgttttgttttgttttattgttttgtttttattattgttaatcttttctacagaatgattgtctctacctctttatgccagaggcagaacctacaggtgccctttttggcttttgttgttgttgtaacattagccccatggattgtaaggtggtttactgagttaaaacagattctgcttttgtaaaatgatggcatcactgtggactgaatgaaatatttgtatagaaaaaagtgcttgaaaagtgtgtttggaactcatcgatagggtaattctccaaaaatgcccaaactctttttctgtaattagccttgccactttcttcagtcacttaaatggtgagattacacatcagtgcaagatgaccattatggttatggtctactgcaaggttgaaaggaaaaatggaggattgtatttaggaaaagggacaactttgtggccacctgctctgaaagtcaaaaggaaatgtaaattagtgtcattagtgtgttggaagagaaatactattcagtaagcttcgccaaagaaaagtgagtcaaagttaatgtgtgtgcgcatttatatgtaggcagctcgtagaccacattttaaccagcaactggtaacaaagagcttagttttccttgtttgaatgctgtagatctgtacctagtacccctcccatctactgatttgtttgtttttgtaaccaaacacattttcagatagaaggagcctt

SEQ ID NO: 548 - DNA, 2212 bp, Homo sapiens
actttgggtgtttagctttctctgcttggggcctgccactccgtcgccaatgctgtttgcttacaaatcactacccacctgctgctgggcttcgtgcctgagaagggtcctaacgaaggtctgttggtggagatgatcctccttatgtaactaaacgtagaggacgctcaggaggaggagggaggccgctcttgttattcatttaaaacggtgcctttgggcggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcgagcttggagttaactgtctgggatcaggccctctttggaatgaacgaccgcttgcttggaggaaccagacttggttcaaagggagacacagctgttggcggggatgcatgctcacaatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtc

SEQ ID NO: 549 - DNA, 3378 bp, Homo sapiens
aaatatggtctttcttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaatcaaatctttcatgaagttccattaaaatttatgatgtccaaaaacacatctgttccagtctctgcagtctttatggacaaacctgaagagtttatatctgaaatggacatgtcctgtgaagtcaacgagtgccgaaaaattgagagtcttgaaaacttgtatttggattttgatgatgatgtcacagaacttgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatattacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgattgccatatgaacttcaggactatgttgaagatacatcggaatacctagctcctcaggaaggaaattttgtttataagttatttagcctgcaagacctgttgttactcgtacgctgcagtgtccagaggatagagacaagaccacgttctaaaaaacggaagaaaatcagaagacaatttccagtttatgtactaccaaaagtagagtatcaagcttgttacggagttgaagctctgactgaaagtgaactttgtcgcttatggactgaaagtttattgcattccaacagctcattttatgttgggcatatcgatgcatttacttcaaaactttttctactggaagaaattacctcagaagaattaaaagaaaagctttcagcactcaagatttccaatttatttaacatcctccaacacattctaaagaaactaagtagcttgcaggagggttcctacttgttatctcatgcagcagaagattcttcactcctgatttataaggcctctgatggaaaagttactaggacagcatacaatttgtataaaacacattgcggccttcctggtgtaccttccagtctctcagttccctgggtcccattagatcccagcctgttattaccatatcatatccatcatggaagaataccttgtacttttccaccgaaatcactggataccacaacacaacaaaagattggtggaacgagaatgcctacacgcagccacaggaatccagtttccatggaaaccaaaagcagttgcttgcctgctcagcaagttgaaactgaaggagtggctccacataaaagaaaaataacttgaggactgtaccatggaaaactaaatttaaaaaaccagttataacagtgtttaatttagataagtttgagggaaaataatcagtaggcaagaggaacatttttcctgtagtagctagagtgccttgaaaaaatgtgttggctatgtgaaggaatatttcaactaaaatggaatggtatgcttttcacccttaaagtttgaggaggatcttgatatgttttaacattatcatggcaggg

SEQ ID NO: 550 - DNA, 2515 bp, Homo sapiens
tggctcactgcagcctcaacctcctgggctcaggtgaccctccccgctcagcctgaccttgcctttaaaggccactgcatgaggtggggaaggagatttgacttccacttgcctcggtgactttgtctgttaagcagaaccataatactggcccttcccctcctgtgctttgggcagtgactctccctagctcattgggaaccctggttgcccaaacagctctcaatccaacactagaggtgtggggggtcactgtggaatgttggggggcaggccccagtatgagagaaaaacccagagggatggtcctgatcagggctacccatgcccctgaggatggtggaatgaaggcagagtcgggggctgcataaaggaaagtctcttccagggaccaaagcttggagaactgagggtggaagggggattaaacagaagtgggtagggcagagccttctgcctgtgggctggatttcctcaggcaagaagcctgtgggtaagctctgtataatgcgaggaggagtccccacaaagcaggctggtcagtggtcacgctagtgtgagtctttcaaacatcccgtgtaagtagatactgtcattgcacagaggaggaaatggaacctggcccaaggtctcaagaaacaacccagccgggattcagactcggcagcctgcgcacttaacagccgtgagcaaccaggaactccccagccctttctcttgtgccttcaagagtgcaagaaactgaccactgcccctagagagctctctgaagagcattcccatggctacagattgggtttggagccgcttgggctcaccatgggccagcattgttttggatggcctgagggcaaggactgtccccgctcttcatgcatcctgaagattagctcagtacctggcacagagtcgatgttccagagaggtttggtgaatacagaaggtccctgttgcatggaatcctgcaaagcaatgttggtgttaccggaaccataggaaacagctgatatccaaccatttttgaacctacacaggtgtcagtttcatgtggttcagcctaatgagagcaccaccttaatcctgttgggttctccatctcagccccaggggaatgagcaacacaggggagctagctggtggtgccagactggggttcagatccctgccacatttacatgggctttgtgacacacgacgggtcatctaatgtctctgaactgcagcttctgcctatgtagaatgggagcagtaacacagagcataaagacatgataggggcaaggagagcaagtgtgtaaagcactcagctccgggttttcatgcacaagtgtgctgcacacttgtgcctgacacttattcagtcgcactagctcatctatagaatgggaggtgatacacgcctagcaggcttgttgtcaaaacaaactaagctcactgcagctggatcagtgatgaatgtcactgtcgtcatcattcccactccacagcctgaggcctggccaagtgctcctgtgatgtgccacaccagtccagcaggcaggggaaacatgctttgcttggtgggattcaaggtgtagggatggccctccctttacagtcaccaccctgggttgagagtttgttcctcctccttgctctgggctggtctctatgtgatatctgaccaagcccggtaactgtgtctgttaggtgggatgcatgacccattccagcctctccacagactcgggagtgctgtctctatgccagggtctgagaatagataccgatacatgggtcagcagctcctgtgggggtgtcactccactgcggagggaaaccaaggcagaagctggacaagagtctgaatggctcagatttgaatcattcgtttttggggggtttttgtttgtgtttgtttctgttgttgttgttgttattgttttgagacggagttttgctcttgtttcccagctggagtacagtggcgcaatctcggctcaccacagcctccgcctcccgggttcaggtggttctcctgccttagcctcccgagtagctgggattgcaggcatgtgccaccacgcccggctaatgtttgtattgttagtagagacggggtttctccatgttggtcaggctggtctcgaactcccaacctcaggtaatctgcccccctcggcctcccaaagtgctgggattacaggcgtgagccaccgtgcccagcccaagcgttagttgtgaaggtttattttgttgcaaatcccagtcctgcatgaaaatgggaatgttagtaacccctgcctcaaggtggggcagtgaaaacaaaaaacaccctgggagtctgcagaggtgtgggcctttcccatcccattctttctgctacaatcaaaatgatcgtttaaaaatggaaatctaggttgggcaaggtaactcctacctataatcctcacactttggaaggctgaggtgggaggatcccttgagcccaggagttcaagaccatcctggacatgatggcaagccccttctcaat

SEQ ID NO: 551 - DNA, 1766 bp, Homo sapiens
acttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcgctgcaggtgtcggcgcagccggcggagcaggagctgcggcggctgcgggaggagaacgagcgcctccgcagggagctgcgcgcggggccacaggaggagcgcgcgctgctgcggcagctcaaggaggtcacggaccgacagcgggacgaactccgggcgcacaaccgcgacctgcggcagcgcggccaggagaccgaggcgttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcgggagctgctcacagaccaccgggtccccggccttctgctcgaggccatgaaggtggctgtccggaagcagcggaagaagatcaaggccaagatgttagggacaccagaggaagcagagagcagtgaggatgaggctggcccatggatcctgctctccgatgacaagggagaccatcccccacccccggagtccaaaatacagagtttctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacac

SEQ ID NO: 552 - DNA, 2033 bp, Homo sapiens
atttgctgagacccttgtgcctggtcacttccgctcccaggatccttgagatgcatcctttcctgagccgtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctgagaagccaatgagctggccatgctgatggccagggcgcactcaaacaacatagacatcatttctttcagaggagcctaccatggatgcagtccttacacacttggcttgacaaacgtagggatctacaagatggaactccctggtgggacaggttgccaaccaacaatgtgtccagatgtttttcgtggcccttggggaggaagccactgtcgagattctccagtgcaaacaatcaggaagtgcagctgtgcaccaaactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctctgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaagcagtcaagaagttgggacctacatgttactaaagtttgctaagctgcgggatgaatttgaaattgttggagacgtccgaggcaaaggcctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccacgtatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctcttgatatttgaggtaataaattcattgttctgt

SEQ ID NO: 553 - DNA, 2447 bp, Homo sapiens
aaaagctggccgtgcaggcgctcaggcgtgcagggtagccagtgccccggccaggaatggacagcctccaggacacagtggccctggaccatgggggctgctgccctgccctcagcaggctggctcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtggcaccttgatgtctcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcaccttgagacgtgggcaggttggtccagccagtgcctgcaggactggggccccttcttctccctggctgtccccagcatgctcatgatctgtgttgagtggtgggcctatgagatcgggagcttcctcatggagcatgctcagtgtggtggatctctctgcccaggctgtcatctatgaggtggccactgtgacctacatgattcccttggggctcagcatcggggtctgtgtccgagtggggatggctctgggggccgcggatactgtgcaggccaagcgctcggccgtctcgggcgtgctcagcatagttggcatttccctggtcctgggcaccctgataagcatcctgaaaaatcagctggggcatatttttaccaatgatgagtagagatgtcattgccctggtgagccaggtcttgccggtttatagtgtctttcacgtgtttgaggccatctgtgtctatcctggagaatgctgcatgtgagacccaaggaatgtcattgtgttggttaagtaacttgcttagactgattctgtgactcctgtctcctctacaatgtacagctgctgatgtctcttgctcagttttttcccccttgttcttatttttttaagtctagctttctagtttaaaatgttctttctaggattaaaaatgtctgcagagcttagtgttcagccaattactggtcagagactgtgttcaacacctctgatagctagcaaagcttccattctctgctgacagatccatgtgtgggctagagacgtattcagagttccagctgttttcaatgtgcctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctggg

SEQ ID NO: 554 - DNA, 2330 bp, Homo sapiens
cttcaaattattcgaatgacccatatgagaaacagagaaaagccaagtatttctggttgaaacggagaagctgggctggagtgcgcctccctccaactccccgctttaactccctaaggttggtgggatggccagctctaagatctcagaaggctgaccagctgtgtgctaagaacaaagcagaaggcagcgaggtttgtacacgctgattgcagttacttaggcacattaaaagatcagcgggtgactggactgaatctgatagtcggagctcttaagcttcgaagtaggtgactttcacagcaaccaaagtgctgagcaggcagcccctttgtgcaaggaggaggttccagccactttcgaagagaaatgagagccccagagagaggaagcccagaagactcagttaccctcttcgcatctacaaagacgaaattgccaccctacctttccagaccagggactccaggtgttgaagggactgcccacaatctcacaggtgcttggcttccaggttcaattagttgccatgccctggggggaactcaggtcccccatcttcctccccaccccaccccccaggaagctctctggccttggctccaagcaggtgtgctcaagaggctgccgactgggccacctggcagccccaggtgctgcgtgcatgctgccatggagacaggcccctgggttggtggcaagaaggcagtctcccaaagctttgccgattcaggggagggagcaactggagcctcaggccctccagagtagtctgcctgaccaccctggagcccacagaagcccaggtgcgtgccctgaaggtttcccaggacaaagggagggaggaggagccagggtaggcagaggatggggaagaggctctggaaggggaagaggctctggaaggggaagaggctctggaaggggaagaggctctggaagggctgatctggggactggggcagggaagcttctgcaaggcttccaggtaaggagaaaggcctttccaggggcttccttgccaggccaaggactgggtgagtaggatgtggagggttggccctctagctcaaggggaggagggaaagagggctggcatttgtccccataggagggacagaccagggaattcacaaaacccatctctgcgctagtcagggatttgaggtagcagggaaggaaacatttgtcctgtagcaaaacccgcagactgcagcttacccccagctccctggattcagggcagccaagggcacagacaatgaccataaggagcatttgcgtccagctccaaagcccagggcgacatctgctccaatgccggctctcttgggggctcttggtaggggtggcccaggccttcaccttgacagaggggaggctgtaggagcatttgactcaactcgatgggttagggactggtgatcaagaacaaaacgcttttgaacctaagtaaaacgtggtgattacacctttcaacacccacagaacactttgccccaggccaagcacaaggatgggacttcatggctgttcctttgctcctttcccccttctgccaggacgtctcccgcgaggcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcaccctgctccgcctggagccccaccatgtcatcctggaaggccatcagctgtgcctcaaggaccagcccaagagccgctacttcctgcgccagcctcgagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattt

SEQ ID NO: 555 - DNA, 1982 bp, Homo sapiens
ctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagcatgtccctgcatttaggcaatgaagtgtttgatgtgtacaaagccccactgcagggcgaccacaatcatcttttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagc

SEQ ID NO: 556 - DNA, 1998 bp, Homo sapiens
atttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacaggaccatcaccttccactgcgcctttggaaagtcagggtggggaagaggcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgtgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttg

SEQ ID NO: 557 - DNA, 1980 bp, Homo sapiens
agacactggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggtccaaagtttgcctcaaagacccctcggccggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacaggtttgaggaagcgatgagggaggctcatgctgtagatcaaaagcttgcagagaagcaggaagatgaagccaccctggaaaataaatggcccttccttggggttcctttgacagtcaaggaagctttccagctacaaggaatgcccaattcttctggactcatgaaccgtcgtgatgccattgccaaaacagatgccactgtggtggcattactgaagggagctggtgccattcctcttggcataaccaactgtagtgagttgtgtatgtggtatgaatccagtaacaagatctatggccgatcaaacaacccatatgatttacagcatattgtaggtggaagttctggtggtgagggctgcacactggcagctgcctgctcagttattggtgtgggctctgatattggtggtagcattcgaatgcctgctttcttcaatggtatatttggacacaagccttctccaggtgtggttcccaacaaaggtcagtttcccttggctgtgggagcccaggagttgtttctgtgcactggtcctatgtgccgctatgctgaagacctggcccccatgttgaaggtcatggcaggacctgggatcaaaaggttaaaactagacacaaaggtacatttaaaagacttaaaattttactggatggaacatgatggaggctcatttttaatgtccaaagtggaccaagatctcattatgactcagaaaaaggttgtggttcaccttgaaactattctaggagcctcagttcaacatgttaaactgaagaaaatgaagtactcttttcagttgtggatcgcaatgatgtcagcaaagggacatgatgggaaggaacctgtgaaatttgtagatttgcttggtgaccatgggaaacatgtcagtcctctgtgggagttgatcaaatggtgcctgggtctgtcagtgtacaccatcccttccattggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggcccttcaactttgcttacacaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaaccaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctg

SEQ ID NO: 558 - DNA, 2509 bp, Homo sapiens
tcatgccattgcactctagcttgggcaacaagagagaaactccatctcaaagaaaaccaaaaccaacaacaaaaacatagctccccacctccagcttgcctaccttccttcagggcacacaccgcagacaccctaggacagacacccaaaaggtgttgggggtgctagtgacggtgcacgggggtgacagcccccaaagccagtgagacccgtcccgggggggcattctcgtgtgccgggcacccccctatggctgtctacaatgtgctgctagatggtcagtcctcccaatagcctcaaaacacgggcatctcattccatatcagagacatgaagcaacctgttcatgtcacaaaaggaagaagtggaggtggcattcaaggaggagcagctgaaaacactagagcaggcccctggcagagaaggaaatccagaaggtacatgccggctgccatcttgctcctgaagggctacgaggcagaagagggggcaaggtctaagtgaccacaagtgggactaactgggggccagcagggagtccgaccttctgcagtgggtgggctgcctcagcaggcggaggttcctcaccatcctgggtgctcatgcaaagaccacatggcctcaaggatggccgcaggccaattgcagggtggagggccccgttcgatgaccttcacggtggttctaaaccagctctgccaaggcagcggcaccgggagtgactggcctcactgacgtagccatctcagcgagaaccggctgagacctgggacaaggcaacgataattacagccaaaggtctggcaccagcccctggccacctgtccccaccaccacccctggattagagcaactgccttggtgaactggatcaggctgggttgggacaaggttgtctctggctcctctctaaagaggcaccagctccctcatgcccacaggagaggcagaaggggaaagccttctggagtggcaccttgggcctcttgggcaccctgagacaggaagaggctctcctggggcaggggtgggagtggagaggactttcctggtcaggctagagaaacagatgacgccagcaggggaggggctggcttgagcaacctgggcctcctgaccccctcccaacagacaggacagaaaccctggcaaaacctggagggacacggtgcggcctccccctctggcagaacaggcatgagtgtagaaactgggctggtgggagaggttggggggcctgggggacaggggggcagttttcacctctgactgaccctggccagaagccccatgaacctgctctcgggagaacctgctccttctgtccccacattgatggaaggcaagagtaccagcttggcatcctatcccagtctccccaccccgagggagctgtgccagtcccaagcacccaggcaaaacccagtagtggtacctcaagacaagggaatggaacagcgaagccagaaaccaccaccagccgccgccttggccggcagcccccgaagcaagcccttggtctcactgtcctcaccggcttcctccaccctgagctgtgtcagctgggtggggactgagggccaccactaggtggaagtcaccaggggtgcaatgtgtgagacctgacaaacttgttctgcgggctgcggatgggtgcgagggtggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagtcatcatccttttcacagctactgttctgctgttgctgctgatagcctgcagctgctgctgcactcactgctgctgccctgagcggagaggcaggaaggtccaggtgcagccgacaccaccatgacggacgggcgatggctgaggagaagctggagaggagatggccaatgccatgacacaggccatcagcctggccctgcagcccttacccctcaagaccaggctcccctggccccagctctggcccagcccaggtacctggacactgacaacttgagccctaccaaggaaacaagggctggtataggtgcaaacctctcatctgccagtggacactgggtgctggggagtcagctgtttcaaagactgggtcaactgcctgggcttcttcgcctacctgcactttttaacaaaacaaggaagtaggggtccccataccttgatggagaacagtccccacctgtgggcaattggcccttggggctctgctgatacatgccaaagaggagcaaggcaatcagaggggctttgtgcaatagcttctgcatccgagctcccgccagagcgtgagcatgtcagtattctagtccagtatttgccagtttccaagtaaaagcttttgtgttacgtg

SEQ ID NO: 559 - DNA, 2103 bp, Homo sapiens
caaactatatcacttgttgtccatttttaatctttctctaacataccctaacttcttcttgaaaatgcttaattttctctgttttgagatgtaaatttgctatcctgtttttcttaaaacttggtaagatcttcagccatgaaggacagacaaactgtaacctttccatttacaaagctgcatttgaattcaactgtccttttaaactaaggagttttactggtctcgtggctaaaattttaaagatgtaggccaggtgcagtggctcatgcctgtaatcctatcacttttggagaccaaggcggggatggatcacctgaggtcaggagttcaagaccagcctggccaacatgatgaaactccatctctgctgaaaatacaaaaattagtcaggcatggtggcacacacctgtggtcccagctactcgggaggctgaggcaagagaatggcttgggcccgggcgacggaagttgcagtgaggcgagattgcaccattgcactccagcctgggcaataagagtgaaactctgtctcaaaaaaagaaaaaatgatataaagtatttatttgtgtttatattttatggatacgtgtctatgtttatagattgcctgtatggtaccaacttgacataaataaattagtactcataaattaagtaaataagcccaaacgcttttcaagttcacagggcattagtaatctgtggtaaatgaagatagtttaaaatttggggtaaaataaaatagaaacattttctgaatttaatttagatatttttctgggtctatttgttagacaggtttacactatctctgctatttttttaaggacctaaaactgaatggacatagaaaattgaggaaagaaataaaaccgtaacaattataagaggttataaaaggttcatggaacctttttatgtcttttcttgtgcagtcaaaaccaattgcaggctggatgcagtagctcacacttgtaatcccagcactttgggaggctgagatgggcagatcacttgagctcaggagtttgagaccatcctgggcaacatagtgaaactctctcactaccaaagtacaaaaggaattagctgggcatgatggtacacacttgtagtcccagctacttgggggactgagatgggaaaattgcttgagcccgggagtcaaaggttgcagtaagccaagattgcaccactacactccagcctgggtgacaaagtgagaccctgtctcaaaaaaaaacaaaaaaaggaaaagaaaacaattgcaattggattgatctgtttataaggctttattaaaattagctttagcatttataatacactggcacaaagttagaatttggatttctcttttgaacaagatttttgtatacattaataagaaatagtaaaagatttttgtttaccttttgagtaaactgcaaaaaatattagtaataagaggagagaatttccctaatgctgtttttattatgtcttttgattgtttggaaaactgaatctcccctctgtcaaagagtaaaatttttgctttttgaaatttttgaattatcagtttggctaaatgaataactattatcttacagtgacctgtaatcttattttgatcaagtgttttaaacctttgatatttgacaaactttccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagtaatcatggctcttctaagtcttttgtcattcacagatgattattgttttacttggattcttttcaaaagtggtttgtaattggctacagcctaaaatctgcttgttc

SEQ ID NO: 560 - DNA, 3503 bp, Homo sapiens
gtgtgcgttgcgctttctcccgcgatcgccctgccggtcgctagctccgagggcgcgcactggatcccaggctcctccgagagtgcggcgacctcggggctccgccggcgccggaggtggctctgagggcagggacgtgttggacacgctgactttgtaggctccgccaagaggcgccgcaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaac

SEQ ID NO: 561 - DNA, 2495 bp, Homo sapiens
attgcagcaggtaatgcccagccccgggcactctgtgcaggtggtgtccttgaagctctacccagctcttggctctgggaaaagggaacaatggacgctgtcgggcatggacatgatggggcttccagaagagttactctgggcctccagggtgacatcaaaggacaggggtgcctcttaaggtgaccttccagccacagccctcttgttggagacaggcatactcccgttacagtcgtcaccacatggctctgtcccagagtcatgcctgtgtctttcagagaccacaggaggaaaaaaccacttctgggatgaggacagggcccttgagagaaggtggtgtttggctgggccaccgaaaacccctcgcccctgccagcacactcagtctcctctctggttgaacagagctctgcctgtggtcctgggtcccagccctgaaaaccacaggtccagcggtggccagggacacaggcccacccctgcaagccagcagacaaattggcagacgcctgaaacacgaagttcatggcaggatcaggctttgtgtcattcacagccctctagataggccgagaaccagagctcgttttttaaggaacaccagtgagtctggagatttttttcttttgcttcggtcttttgcagctttctctactaagggttctcctttttcacccaagtaattgcctttccatctaacggcccaaatggtcaaatggcatctactagtctcatatgaccgctgcctctctggcctcgcccttctgctgaggtcagcatgacctggaactatccgctggtccctttcagtaacctgaagctttcgccgtagacgtgctgtattgcccagaagccatcgtgtcgctggtcggggtcctgcggaggctggctgcctgccgggagcaccagcgggctcctcaagtctatgtggcccttaccgtctgcaacccagagatgtgccagctgttcaccactgagctatgccgggctgggatcagatgggaagtggaacctcgtcatgaccagaaactgtttccctacgaagagcacttggagatggcaatgctgaacctcacactgtaggactcacatacgactccaacgggattgtgagaatcaagtcactctcgtgggaagagtttttatatgggaaagcggataaaactttcattggactggaatgtttggagaatgttaatttccaaatcaggaaccacaaactgccctctaataagacatcggctatctaagcatgtgggtgctccctttctgccagcaattctggttcttaagaaaatcaccatcaatcagacatgaaatctctggctccaaaaatagcattttctttgtgcaaataaaaacgtgtgtatcaagtatggtgttcccccaatgtggacacactcggttccccacaaagccaagcccgctgcagctgccacatccctggacacatttggttcctcacaaagccaagcccgctgcagctgccacatccgtggacacactcggttcttcacaaagccaagcccactgcagctgccacatccctgggcttacagtgcagcaggtgcttttttcaagacaggaatcaaaatgttaggaacacggcggaaagatgacacctggagagcaaacgcaggatgaggagtactgcagaggtcacacggaagtcgcagaacagtaatccgctagcaggggcatggggcgtgaagaacagaagaagataggaagtgtttccgagcctccagaaaagaaatcagagccaagcacagcttcccgggtcacagaaccaattcatttaccaggcggcaccactgccgtcatttcaccttctggccactgggaggcgctgctcgaaagggtttgccctgagactccgagaagaagctgcgggaaggacagcaggggtcccggggttttagcctctggcccaggagttatgtgtccataaccaaatggagcacactctgcacccatctctcatcccatcggagctgctgcgattcccgcaggttcttccggaactggtttagcttgcccgcaagatcaggaaagtttgagaaaagcatctgcaaaaaaataaagagcagagcttaactcatttcctgtccccaccccatcccaggtcaccacctggctgaccccaggtccccgacccaacaacaaaccctcccaagttcctaactccctcacttggactcgagactcttcacgccccagcagcgctccgcctccaacttgacatcacgctttctgtcccactttcccacacttcgtgccctggagcacctcccggcctctacacgctgtatgttcccctgcgagcaccctcctcttggcctctggccaagtcccacccatctgtgggtaacaagggggtgttggtgttcttttcagccttgctaaactgtctgaatcaaggatcacaaactacagcctgcaggccaaatccagcccacagcctgtgtttgtaaataaagttttattggaac

SEQ ID NO: 562 - DNA, 2020 bp, Homo sapiens
acattgccagaaaacaggaggaagagcaggtctggagtaaggctgggggactcaagcgccaatgtgaagctgaagagcgtcctggagacagggggcggtgagacggagtctgcccaggccacaccagtggccggggtttggacctgggcctggggagggtcgctgtttgagaggaggacgcagctttataaaatgactccgctgtcgtaaagattaaatgggaccctatatgctgttagcatggtgcctggcacagggcactgtactaggcactggggatacagcagggagcaaaacagtgaaaacccctgtcctcaaggagcttctatgctggattccacagccacacactcaagtctttgttgtcagccctcctctcccttagtctgcaccctcccctgagcctctgcctcagcctcctcccgggctcaggattccctgaatttccctctcctcacacatcctgtctctaagctccagatgcgcttttccagtcacttgcaatggggtgacctgcagacgctcaaacctggcacatctgaatagtaactcacaatgcccaaccccttctcaaacctgctattcccactgggttccctgaggagccactgtccagacccctcttcctccaacatgcagctcttctatcgccatcgccaccatgaatagagcacttagtgcaggcaccatgctaaaagcttttatttattaaatcatggaatcccctgacgtccctaaaaaccactccacttgttgcagataagaaaaccgaggcggaaatcgttaaacagccttaggttacacagttaggcagagcccggacaaagagcccaggctctctggcctcagttgtgcttttcctgctgctgtgctgtcctgcttcgggtcccatgggcttgcctcagctgtaccactgacctcaggcccctcctgggccgcatctagctctgccctgggctattgaagagcctgctcactggtatctctaattccctctggcttcaccacagaccctgctgccagggctgcctatgatcccctccctcacaggcgggatcacttccccagcaccaccacacccctgcacccctgcaatttcccattgtttacaggcagcctggccctgttccagaccaacttccccagtcccatataacctctccaagacccttcttctccctactcattccccacgtgttacagccaggcaggccgtccaccccaatgctttcctaactcccgtggcttcctcaccccgtctacctttactgagctctgtatcctttaatacccagcctcaaaggccgtctctgctgcaaagccctgcctggttccctgtcagactcctctggctctctctgctgtgcccccacgggtcttcacctctggctgggttgacttcataccacctgggattattgtttgttatctgtgtccatctgtgtcctccagtaacccatgatcttcacaggccagtgccctgtgttagtcatctctgggtccccgtgactgacagggctgggtgcagtgcgagcctcagtactgaaatgaacagggccggcctacgaggtcactccgcgatttggggcaggaaagatctgagtttctttctgcactcccgtcgagtcctgctgtagaaaccacaaatggggaatgatcgttgaatcccagaagactgagcaggaagggccgctgcaggtcatctgtgttaattctttatctttgaaatgttggagtgaggcccagaaatgagaaagacctagcccacgatcactccacagggaggagttgtggttggaattcagacccctggcttctagcccagtgtgctttctgctttgctgaatcattccatctttgctttttctctacacaaaccacctactacaataacaacaattgcttatgctgaaaatcagcccagtctcatagctctggaacctctctttgtccccttccagataaccacaggacactttattttacacttttgtcataatgattttacactctcattttt

SEQ ID NO: 563 - DNA, 2755 bp, Homo sapiens
gaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatctccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctc

SEQ ID NO: 564 - DNA, 2792 bp, Homo sapiens
agaaccggaagttgttgcacagctggcagttccccggtttctccccgacggcgtcgggaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactgattcaaaatatgaacatgcgattgcagaggcccaaaagaatatgtacttcaagactaggctgaagtgccccaggtcactttcaggaggcagataaataaaggccttatcttatgaaagcacacaagagcctccatactattaatatcaagttaatttcccgtgttggaaaaaaataatctcctttgcaatgtaatttggaaataagtcaatggaaacatgaaaatgactgcttgtctacaaggagtcagctaaacataaggaatgttttcataacaatattaatctatgggtgcttctgtaagatggatgatcatcttaatataaagaaaaaagggagatgaacaaaattgtcaaacaagactgatgtaccacaagtgttgtcaagtacagtgtgtgtcggagagatgtaccacagcttaactggaagaggaagcccgtaactgctgatgacaatactttcagtgtccccttttctggcataaatcaactatgaatatgtttcaagcatcacaagacaaccttttcagagtcttctgtattcttagtaagatgagtttctagacacgctgtcatgaaatgagaccctggattttgatgctcttgtacatatggacaaatcactgaagttcaatttaaagggtccactgcagtcccttataaacaattgttgaacctaaccattatagtttataagttttaagacatttatgggatatcttatttggcttatctatgatatgagtaactatgttttacctgcatttaattcagccagattccctgtttaaaaataaaattactgaatcgtacattattaaagttattctgacagtatacaaacaacaaaattatctattttccagagattcttgataaaactctgtaatgttactacaataatacatgtattgtgttttccatggtgctacagttacacaatatggaggcaaacatcagaaatcaaagtccttggaataagggaagagactcatagtaaacttctttgtctggttgggttcctcataaagtataaaacatttcattctcagaaaatccaaccatatcttagagtatctccagaaactggcttagaggagctccaaatatgtggaattaccacactctgcttagttagtatgctgataaatgtaagattagtaggaggagaagtgaatgtaaattttattatagaattttctgatagtgattatgatttgtagctctagtgaataagaattttatattgagttgtgtgtatcttgagtcactaaaaatgtaggatactttttatttggggctcattgtctttgtaattacggagaggaacaaaccatctattgaaacaacaagtgcctcagagatgtatatattgtgaattactgcttaattacggaaagagtttcttaggttctatgtgaataagatggcagaatctaaatcaagtattttgaaggaagcacccatcttcacttggtgctgccatcaactttgtaagattgcattctatttattgtgaataatttgagtgtttccacaggaaagtggtatgaatcatatcgtctaagtatatgatgaatctttaaagggtgtctctgtgtactttgaattattttgcagttatgtaggtatcctaatgagtgaatggtactagtttttataaaaggagaattcattgagctaaccttggttttaaaaattagcattagcacccccattatattaattttcagggatagtaaatactccaaaatg

SEQ ID NO: 565 - DNA, 1467 bp, Homo sapiens
aaattcaacaaaaggcgaaatccacccttgcaatgagtcaaaagcttttgtatcctacctgatatgcctggaacagcgtatacggggaacctgtcatactggtagctggactccttatggccccccctttgtttgggggccttaaatggcttccccaatgacactctggggtttctcccaccagacagttgtcagcacatattccaaatcaataacagtgcccccagtgaaacacagcacctttgttacttaaattacacattacagcaatacgattgtagtagaactcttccccttccctggggggccctctgtgtatgcggatcctatgggtggtgatacttgcccccgaactgaacagggagatgcacttgggggtggccattaattccattcactatctgggataatatttccccccccagtaatctagttacttacaaatattgctggttacaaatgcgccagactccctggtggtggtaccatatcactgctggtacaatcctgcttcaacaacaaattaaaatactaagcttgcatgtagaaaaagctcttaatgctagtagcactggacttacgttgttatcagatgaatttgctcaggggcgtactgttgtgttgcaaaatcaaatggcattacacatccttacagcagcccaaggaagggtttgcgccttactgcatgctgaatgttgtgtgtatatccctgacaattctcacaatattactctccttgcccaagacatgcaaaaacaaagcagttagaatataaccatgggcaccccatcgtgaattggctgtccgactggcattggcgttggccgtggtgggtgtggtttttattaattgtgcttttaattctcctgtgtttaccctgtatctgtaatctatatcaactatgccttccccatgtatctttacacgttttatccacaactgagtatcaaattgaggccgaatgtggaggaaaagttaaatatttaatttgaactcaattgaacatggacataaacaatggtcaccaactcccggaacaggttgcatgagccccttgaggcattcatccagcaaagctttttagagaaatctgctcctgtacgtcagttactgagaaacaacagacaatcacaaaaacaagtagacctttttgtgtcccttgagcccagtctcgaagggccctcgtgactgggcctcatgccaaacaattcattacaaaagagctagggtcccagaccgcactgaagctccatgagacctctcctcgtctgtgcacggaccggcggcccactctggagcccaggctgttgcttcccagtctggtgatgcttcctccataatctggtggtgtaaatatatatggacatatcttttcccttcactcctttccactgcaatttgcttgttatatcatttgcttattatatctatattgccatatacgtgggataaaggttgttcaccctt

SEQ ID NO: 566 - DNA, 2360 bp, Homo sapiens
cacgatgccccaggccacctccccacctctgtggcccctgagcctgcacggaggaaagggtatcctctgggcaaggcacagccacccgccaggtcctccctctcaccacatccaggacagtggacgctgctccctgcctcttcctcagagtcctggggtcacacctctacctgcgcggctctcgggggccacccctctcagccccatccggctcctgagcagctttgtccccagagggccccgggtcattcctctgaccaaccaggcacggcgcaccctgcatgcaagcctgggcgggtgctggggacggacgagtgacgcagcagacactgcctccctgaaggcatggcaaggtgggacgcttggccgccacctgcaggggcctcacctgaccagtccccagcctcaggaggcggaccccagcagctggagccccagcagagttggggggatggtggcatctgtgtcctgggctctggggccacctcactgtgaggaggaggtgtgggcgttgtgggaggtctcatctcggggccatgctgatctgggctctgagagctggtgtccgctgctcctcccctcccatttctcctctgagagctggtgtccgctgctcctcccctcccatttctcaacaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcacttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctc

SEQ ID NO: 567 - DNA, 3343 bp, Homo sapiens
gtgcatgctgcagagtgctttactttcaacaaggaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgatatggatgaagaaattgaggcagaatacaacattttgcagttccttcctaatcatcccaatgttgtaaagttttatgggatgttttacaaagcggatcactgtgtagggggacagctgtggctggtcctggagctgtgtaatgggggctcagtcactgagcttgtcaaaggtctactcagatgtggccagcggttggatgaagcaatgatctcatacatcttgtacggggccctcttgggccttcagcatttgcacaacaaccgaatcatccaccgtgatgtgaaggggaataacattcttctgacaacagaaggaggagttaagctcgttgactttggtgtttcagctcaactcaccagtacacgtctgcggagaaacacatctgttggcaccccattctggatggcccctgaggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagaaatcctccacctactttacttcatccagaaagatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccgaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagctgcagaaacgttatgcagacttgctaatttacacatatgttggagacatcttaattgccttaaaccccttccagaatctaagcatatactctccacagttttccagactttatcatggggtgaaacgtgcctccaatcccccccacatatttgcatcagcagatgctgcttaccaatgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacatagcttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctatacccgtgggatatgaggacaaccgcccgctcctggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtgctgggaaaaacaaaggtttttctcaaatattaccatgttgagcaattaaatttgctgcttcgagaagtcataggcagagtggttgtgctgcaggcatataccaaggggtggcttggagccaggagatacaacaaggtcagagagaagagagagaagggagccattgccatccagtcagcctggagaggatatgatgctcgg

SEQ ID NO: 568 - DNA, 2200 bp, Homo sapiens
atttcgagaggtgttggctacagacaagctcatgatgggcaggtgaagggggagcagctttcctggatttggagataaaaggtctcttctgtgaaggcaagggtcgctaacccctaaccgcctgggaggaaaggagggagagaaagacattgtctctcccagtcggggagctggtctccttttctgggctgggcagtctggtgggagtgtgtgagaggaatgctgtgggctgcagaggcaggggtgctgtgtccttgtggcctcctgacatggccaaggctgcagagagctggaggctcaggatgcccttatagtgcctctggaaattacaggttccccctgctggtaggcacatgccttggtgagcagaggccaagtgaaaaaagcccctctccctctggttgggaatgaggacttgcctcatgaagggatcccgggccggtgccctaggcagggcccatggtggtctgtctggagatgtgatgtggctcgtgaattcctgcggaaactatctctaggtccttcaggtgaccgcacagccccgggcagttgccctggagcccaggtgtggagtcccagccctgcctctgatgctgcaggtggcttggaccagctactttgcccttctgacctgcagtctccttacctatagaacgttttactggagaaccctgagagcagagggatgcgaggccaactgctggtagcagcctggtggggtgagggtctagggttgttttcttaagatccagaagtttttgctttagcttaaggatgtgtgcaattttccatgtggcttcataattcatccatgactttgaattttaaaatggagagaagttggcttcccaggaaatggtgcccctggccctgggcatcggcccacctggctgtctccaaggctctccttcccagtggctggtgcgggctccgggagctcagctgagtcccattggggtggcagcggaaagggagcaggggagtggggagtacggagatgcaggctggaaactggcctccaggaacaactgtgaggttgaaggcgagatttccatgttgggagcaaatttaagagccccagatggacacggcacacctggagacaggcactgctgcctgagtgtggcccagggagggctcggctccccaaagctccacggggcaggcccagacctcccagcagagtagggacaggctggttagcccagactcccgcctctgaggagaggaaccagctctccttgggaagagggcctctgccctggccggccctgactcccaggggacttcgaccccttgcttcatccctttatgtttctatctcctcagtgcaaaagggcagcgtgcttcctctctgctggttccgtgggatcggagccaggccccagtgtgcaatgtctttgcacacagataatagcgtgcgtgacagaggactctgtgcttagctgtcacctgctgccttcctgctgcccggtccccggcagaacccgcatgcctccctccctctctggaccctggcagtctctgcgccctggctccgagggaaggggcagggggcccgctggtcggcgagggctgggagcccccgacaccttggctccaagggaaggggcaggggtccgctggtcggcgagggccgggggccccctggtgtcgggcctgggaacagccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggac

SEQ ID NO: 569 - DNA, 1954 bp, Homo sapiens
agttgtccttgactgcatggtttctgctggtccaagcaaacttctcctgccacgcctaaccttggagagcaggctggagtgcggtggcaccatcacagctcgctgcggcctcagtctcctgggcttaagggatcgttttgcatcagtctctgggtagctgggcctacaggcgcacaccaccaaacccggctaactttttattttttgtggagatgggggtctctctacattgcccagactggtctcaaactcccggcatcaggtggtcctcctgccttggcctcccaaaatgctgggattacagtgatcaatggaggaagtgtttcatggtggacatgggaaactggccagatcaactgctgtcaccttctaagacccagacggggaggaggaatgccagagaagctgcagactctccggccacggagcctgagtggagcagaggtggcccactgtcagccacaggtcaagtgtcagggtggggacggggcaggctccaccagaaggcgggggcaggctccaccagaaggcggggccagaccacagggcaaggtggagatgagtctgtggcacccccaggaagtttaccagatttgccccagagcttctgaccctttggatctctctgggctgcattcttcagggtcccattgcttctttcttgaaggtggaaggaaatgttcccatcagagccttccaacaggccaccttgggggcttctcctgagagctccttgtgcacacaccccttcagggtggcttgggttgcgccctcagaccccagtggggggccgtatggcatcctccttggtcagcaagtgagccacagcagcaggcccctcacagacctcagcctggggccacaggtcccttctccccatctccgcatctggagaagcaacctgtggagcagccaagagtggcagccctggctctctacagcattcattttcagggcaagacagagcatttccactattatgctcccccccccggccttttttttttttttttgagacagggtctcactctgttgcccaggctggagtgcggtggcgcaatcatggctcactgcagcctcgaccttctggggtcaagtgatcctcccaattcagcctccaaatttctttaaacaaaaaaaaatgcaagaaaggcaaaacaagatatttatctgggctgagagggtaaagagaagctctatctttgagctgagacacaaaatggaaagaagaggcagcagcagcggcagtagcagttctgcctttccaaaccttccctatctaagtgctttcaagatatgctgaaagtcatgaattgaagtgtggttcccacggctttagtccttgtatgaaggtccttttgctagaacttacttcctttccagcccatatggttgacctgggggtccaggcagttctcaagggaaccacaggattccatgtgatctgggatcccagttgatgatccctcttctggtcacaagctgaattggacccaaatctgcaccctaaactcccctcttgccagatcctgcccagtcagtgccgtcccctcagactgggtgggcagcctgggcttcctgctgagacgggacccccccctctcttcttgatctcactcccaggaaagacactgaaggagcagaggtgtggacgccacatactggacggggtttcaccatctgctgggacgggacaccctctcttcttgatctcactcccagaaaagacactgaaggagcagaggtgtggacgcctcatactgctagagacggggtttcaccgtgttggccaggatggtctcaatctcctgaagtcgtgatccacccgccttggcctcccaaagtgctgggattacaggcgtgagccactgcacccggctgaaattgtatactttaaagggatgaattttatggtatgtgaattatgtctcattaaaaaaaacaaactgttaag

SEQ ID NO: 570 - DNA, 2774 bp, Homo sapiens
gctaatggtggacgcgtgaggcggaggcgcgggcggcggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgaggtgcgcggcgccggagccgggcgagggccggggccacgggcggagtgtgtcccgcgtggccgccgggcgggggcggacggcgtggacgcgtgccggctgtgcgccccctccgggccgcagacccgacccgctttcccgacggcggtgcccggcgtccggatcccaagggctcgcggcgggcggaggtgggaaccgggccaccggtcggggatacgccgcccccgcggggccgcgagtcccccgggatcgagacggggaccccccccaccccttttgtccgggtaacggccgagggccgggcggccccgcggtgcagacggacagtcgggcgggcggccggaaggaggacgccccaggcctcggcagagctgggccggagggcggagccgctccgggcgagtggtccgagggtccgcgtgcctggtgggcggtcggcggcgtgcgcacacgtccatgtgcatttgtgtttacgcacgcaccgcgccacggcgtcggccgggcaccggggaggtggcggacctgcgggcacgttggcgcgcgtgtgaacgcgcagccccctggtgcgtttggtgtgtgatcaacgcgtacacatgtggcgggtgtgcagatgccgcccgtgcccggcacggtgtgatgtgtgtacacggcctggagtgtaggggtggcgtgtcggagccccacactacaccacagggatgagcgtgtatccccttcagaggtgtgcctggggactccgtgtgcgcgactaggtgctctcctggggctggcaggggcatctgtccctttaccggtgcaatggggagggtgcacacggttcaccagctttcgggctagctgggtaggaggtgatgctgccccggtctggcacccactcccccgggcctctcctaacccataggacagtagtgctcctggcttgtgctgcccagaggctacctggctttccctaattcaccgaccccaggattaaccccatggtggttggtatcaggggatgaggccagagccctttgagctgtgcccctcacaggggtagggtcatggcctcagccatcccagtaccatctgtgcccagccggggactgggaacctggtttctccatgaggagccatcccagggcctgcaggagggactagaagccagaggactctgaggctccgcttcctggggactgcagggggatcagaatgtcccaagcttgggacagtctgggaaggcagtggccatcccatccagatgagtacatccctctctccttgcctacttccctcctaccagccgtcgcggaggccactgatcctgtgtggtgttcaccccaggacgtgggaggctgctctgtccctctggccttagtttccacatctgtatggtggggttggggggcatgagtcagcttctgttggccagcttactgccccctgtgccccaaggcagccccacccggaggaagctccctgcttccctcctggtctccacagccctcatcagccctgtttgtgtcaggggctggatgtggcaaaacttgcaaaaccgcattcatggcagtcacacatctgcacgcagggttccctccctgcctggggctgggcaggtaggtgtccggtgggaagcgggccctgcctgcaggactcagcccagccctcaaaacctggcacccaggccacatccctcagcggcacagttaattgaaaatgcagctttgaggagtgcaatgtctggggaaagactgttcccagaggggcaggagcatctggggcctctggtggctcccagggtccccatgggaggagccctgtgccctccactcccaagtctcagttgtgccatctgtaaagtgggggccgccagggaggctggaggaaggtgacgggacttcaggccttggaatggggctgagtgaggggttcacatggccaccccatccctctccacgctccacccgctggctgcatccaccaggcggtgtttctgggtcacatttgctgcaattcaggtgctaatgggggcaggaggctgcagggggaggggccggtgtctagtggggcagatgtttctcaatggagaatgctcacagcggcctgcagagggggtctggtgtggcctggggctcctggggttgggatttacacagtgagcctgggctttggggcacagctgctgctgacagagggtcttggggtctgggaaggtgcttaaagcccggcccccatgcctgagctcccacacccctgtttagggacacccagatagggtgtctcctgcaggaaattccccacataattcatttatttaaaaaatattttttgccgggcacggtggttcatgcctgtaatcccagcactttgggaggccaaggtgggcggatcatgaggtcaagagatcaagaccatcctggccaacatggtgaaaccccatctctactaaaaatacaaaagttagccaggtgtggtggcacgtgcctgtagtcccagctactcgggaggctgaggcaggagaatcacttgaactagaaggcaaaggttgcagtgagcccagataacgccactgcactccagcctggtgacagagcgagactccgtctc

SEQ ID NO: 571 - DNA, 2292 bp, Homo sapiens
ctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggcgtccctgggctggtcagctgaggaggagctgctctgtgtgcaggaagatggtgctgtactggtttatgggcttcatggtgacttccggagacacttcagcatgggcaatgaagtactccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggggctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacactt

SEQ ID NO: 572 - DNA, 2037 bp, Homo sapiens
caaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacacctgagtcattc

SEQ ID NO: 573 - DNA, 2006 bp, Homo sapiens
aatcgctcctctcctccgctcggggacgctcccccggggaatcctgtggctggagatgctcggtcgagtccctggtatgtggtcaccgtgcgggggccgctgcgggtgcggaatccagacccgggggtgtagcaacctcacaactccctgtgcagaagaaagcagaagatcggggcgcgggtccagggtggtccgcacagccgtggtttagccgagggcggcgcgctacacttagtctcttgtgcagtgctttctggccacagcagcttccctagaagtgaccccacttgggtcagaaccacccagctgggccgctgatatttccccctttcgcagagggagcagcgcgcgtcgggagacgcagtgactcgccagggtcagacccagagcttcttccccacgcaaggccgagggcagggtgagcacaggggcgttctccgtctgccccggctcgggtgcactggcctggacgcctctgtgcaggttccatggtgtagagagacggctcgagtgcaggcggagtttaagggaagggggttttgactgcgggagccgaaagaaaggactaaatccaaaaggtcctcttggacctgaaccttctgctacaagcctgaccgataaaaggggactctgcatctttttaagcccaaaatagaaaagccttgggagttagaatggcagaaaccccagaccgacggcgctggaagcgcgcagctcggtgcattccccggccgcactgccctgcggggccgcgcacgttccagcgctcagggacggtgccgcaggacacaccccaaacacagagcacagacgaggtaaaaacgagccggctgcaccagggaccacgctgcccctagctggctctgccccagcctctctgaacagcaggtccctgcgtcgaagcccgagggtcttcgcatttgctgctgtggcttctcccggatacccacccccttcagatcttacagaagggccttcttccaaaccaggccttccctgttccctggcaactggttttaaaatcacagcacctctgctcctgcaattcacagtccctcctcagtcccttcactgcttagtttttttttccttagcccttgccgcagtcaaactcgaatgcgtttgtgaatcacctgaggaccttcctacaacacagatgcgaattcacttggtcgagggtgggtccccaagtttctaacgcgtgtccgtgatattctgctgctccccacctgcctgcggatctgcgaggacctttgacttacaaagggtccaacatgcagataatacaaaagtttatttttcctatgtattttggtttaccatcccccgaacttgaatgtgagttccaccaggatagagctctggtctgttttgtttgctgctatattctctgtacctggaacaggcctggcacatagtaggagcactatgttatttccagaaggaagcagtgaatgaaatacaaaccagaaaagacagcagaggtgataaacctaacattatacaaagtgaaagtcaaggtgcaaattatgaacgaaacaaaggttttacactcatttttaaaagggagaaataacagtcacaagcccttaggtcctaaagtaaaaactgtctccccaaaaaaggaaaattgcaaatactacattgattttagaaaggttaactcccatcttggtcacatctcagaagcaaaaagtgacgtaaaagacttgaataaagaaattaatggccaggcgtggtggctcatgcctgtaatcccagcactttgggaggccgaggtgggcagatcacttgacgtcaggagtttgagaccagcctgggcaacatggggtaaccccgcctccactaaaaacgtaaaaattagctgggtgtggtatcaggcacctgtaataccagctactcaggaggctgtggcaagagaatcagttgaacctgggaggcagaggttgcagtgaactgagattgtgccacttcactccagcctgggcaacagagtgagactcgtc

SEQ ID NO: 574 - DNA, 2427 bp, Homo sapiens
aaaaagcagccaatgggagagccgaggcggggaggtgcggccaatggcgcgggcctgtttgattcaaaggttgcctataaagcgggactgcacgccggtttttgtccgagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatagacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctcttt

SEQ ID NO: 575 - DNA, 3197 bp, Homo sapiens
attccaggtcagcttggctgtggtcttagaggcagggagtgcctacccagtcctgcctcaggagcaggatggagtttcactctttcacccaggctggagtgcaatggcacgatctcggctcactgcagcctctgccttccagtttcaagcgattctcctgcctcagcctcccaagtagctgggattacaggcgcccgccaccatgccggctaatttttgtatttttgatagagacggggtttcaccatgttgtccaggctggtcttgaactcctgaccttgtgatccacctgcctcagctccccaaaatgctaggattacaagcaagagccaccgtgcccagcccaccatctccattttgcaaaggaggaaactgagacacagtgacaccaaggatgacaactggagtaaaccatggaggcaggattctcaccctaacagatacctcaacaggccaaatttaagtacttgtggaaggaaaactaccatgtcttgagcacctagcgtacttcaggcaccatgttaggtactttgtatgggttaactaatttggtcatcgtaagtccttgtgaagggggcactgtaagtcctgtgttacaaatgcaacaacttagatggagagaagttaagtaatgtgtctctctttgcccagcttgtaagtggcagagctgggacttaaacccagaggagacatacacatgactgtgttgtgttgtcaatttttagaagttacattacttaattgattggttaattcttttaacgtgtgatgtttgaaatgtgtaggcatctaagacagtatgtgggcagggggtgggcagggagacacacaaagatgactctgacctggctactagcaggcataagccgtaagtaaatgactacagtgcaaggaggaatgggaggagtgccgctcaggctggagagcattctggggtgctggggatggcagagggtacttgtgtctgctgcttttaccttctgcaccctggggagggtggttcagaagtcagcctgccccaacgcaaagcccaggctgcagatgctttgacccaattctgctcaagctgttggtcatctccttccaacactcaagagactggcttttgtccctggatggatcatctctgctctgatgattctggcatccatgtgagaaccagcaggggaacagctatgcaacagaggcctctggaacctcacgctctttagatgttaaattgaaatcaggtgctttatgactcgtctgtattcaggagcccatcaacgctgcatgggaactgctgtggattcaaaaggaacaccagtgtcatccctgcatggccctttactccactgtgctccatgttctcctcactccctcccaagggagttttctcccatctgcagaccctgctgggtggggcagaaagagcactgggtttggactcagaagatccaggcccactatctggtctgtcactcagcagcatgactgtcacgaaggctctcctaggcctcagtcttctgagcagtaaaatgggataataatgccttcttgcagagctgccatgtgggttacatgagaagtatgtggaacggtaggtgtcacacttactgcaatttccaggcctcacggactggcatacagctatggccaagtcattcccacccttcaatcctctgtgaagggcttcctgactgttccagcctgcctgacttctggagggatgtaggactgacccgaagtatttggccaaccacggggaggggcagagggggcagacactgggtgaatctgggctttgggctgtgtggggctagtgggctcctccagtgtacaattcttgagaggcttcccagtactggtagaataccacccaaacctctaatgtgctccacacagtcctgcatcctctggcctctgactccccagcttcatctcacaccacactcccccatgctctcagtgttccactgcaaacagctttccacccccaatagctttccttatggtcctccaacatgccaggctcttccctgcctcagagcctcggcagacactgtctggaaggtactttttcccactgctcccttgggcaactgagtaatccttaggtctaaacccaagtgtcacttcctctgggatacctcccctgatccatgcaccacctcctcccacgctgaacgaaactaggtctctgctatagaactgcatcttctcctgattcatagaacttatcaccatttgtaattatatacatgtgaacctatttatgatttaatgtgtctctcttcgtgtggattggaacaccttaactgatcactgctactgacgaggattcaccacagcctcggatatagtggtattccatcagcgtgtatgaagagtgaatgtctacatgaaacaggtagcgacaaggggcaagaggatggaggagagtgggaagggagtggtggcagtgatgtgcctgagaggtaccacggtgggcagcagggaaaaagcagagggctctaggaagtgaaagaatgggtcaggaggaagacctgagagtgggctgtttgcatttaagatttcagaggggcagccatgaagcatggcctgttttgaggctcctaggaaggggaagatgcagccttgtgatggagttttgtacagttagggcatccagagtgccctgggactgggaactggcaaggaaataagagagagctctggaatggggggtgagggggagggtaccgatggtgcctatgtccctgtgttatggggtggccctgcactccagatgtcaccagtatcccttggactcagtaggagggagctctctccagggaaaagggaactctgttaacataaccgcggtgggggttaaagagcagctttccctcagtggtacagagccctgtggctggcagcgctgcacaggctcctcgagactcagctcccactgtccctgagccacactggggctcttcgccctcctggcagcaattataaagttgaacagcagaggcaggggaggatcgaaagccaaacaggaagccaataattgcctcttgcagaaatagctctttcaaaataaaagtgaggtcctgaggttcctacccaggtcagttatacaatgctgctcctgtcctcccagagccctgtaatcttcttcccagtgtctactttctggccctgaactccagtacaggtcaaaagatgtccatgtg

SEQ ID NO: 576 - DNA, 1908 bp, Homo sapiens
acctggagcgcgcacccgcgctgggcggcagcttcgcgggactcgagccctggaacccgagaagcctttttggcgcttcctgaagcgggacgtacagattccttttgtcgtggagttggaggtgctggacggccacgaccccgagcctggacggctgctgtgccaggcgcagcacgagcgccacttcctcccgccaggggtgcggcgccagtcggtgcgagcgggccgggtgcgcgccacgctcttcctgccgccaggacctggacccttcccagggatcattgacatctttggtattggagggggcctcttggaatatcgagccagcctccttgctggccatggctttgccacgttggctctagcttattataactttgaagatctccccaataacatggacaacatatccctggagtacttcgaagaagccgtatgctacatgcttcaacatccccaggtaaaaggcccaggcattgggcttttgggcatttctctaggagctgatatttgtctctcaatggcctcattcttgaagaatgtctcagccacagtttccatcaatggatctgggatcagtgggaacacagccatcaactataagcacagtagcattccaccattgggctatgacctgaggagaatcaaggtagctttctcaggcctcgtggacatcgtggatataaggaatgctctcgtaggagggtacaagaaccccagcatgattccaatagagaaggcccaggggcccatcctgctcattgttggtcaggatgaccataactggagaagtgagttgtatgcccaaacagtctctgaacggttacaggcccatggaaaggaaaaaccccagatcatctgttaccctgggactgggcattacatcgagcctccttacttccccctgtgcccagcttcccttcacagattactgaacaaacatgttatatggggtggggagcccagggctcattctaaggcccaggaagatgcctggaagcaaattctagccttcttctgcaaacacctgggaggtacccagaaaacagctgtccctaaattgtaatgcatttgtctgttgttgacatgagagattcaagatcagattctagtgttcagtaaccctatgtgaatcagatgtctcctggataacattaaagccatgtctttgtcattaatggtgtattttacgtaactttgttgaataagctttgtcgttagttttactaatgtaacttgcttgttgtagaagattaagaggcatatgacacatataagtgaaaaacattcccaccagttaacatttgtgtttccttctagatttttttagttaatgttttgagtcacaggtgagctttaaagctggtgactttttccatcactatgaaagaatggtcacttaatgtttgctgttcaaccatcagtagcagggtagaattttctttggccagaaacatacagaggggtgttaatatgaggaaaggcagctgaccttttcattataaacgtgagagaagactcttttgacaggaggagatgagacctgtctctagaatagttaagtctgtactctcttccaagggtgaattactacgatctattttccctctcacttcctctctaagagcagaccctggggccgagtacagtggctcacacctgtaatcccagtactttgggaagtcaaggggggcatattgcttgagctcaggatttcatgaccagcttaggcaacatggcaaaacccaatccctacaaaaattagccaaacatggtacacgcctgtagtcccagctactcgagactcagatgggacgattgcttgagcccgggaggtcaagattggtgcagtgagccgtgattgcaccactgcactccagcccaggtaacacagcgagaccccgtttc

SEQ ID NO: 577 - DNA, 2120 bp, Homo sapiens
aatacaactgcagtggggctgcttgtggtttccaaacgtcggcagaggctggagacggctctctagtgctgggtgtggagtgaggcaccacccttgccctgaagcctggggcactcagtcaccatggctcatgccccagaaccggacccggccgcctgcgacctcggggatgagaggcccaagtgggacaacaaggcccagtacctcctgagctgcattgggtttgccgtggggctggggaacatttggcggttcccatacctgtgccagacctatggaggaggggccttcctcatcccctacgtcatcgcgctggtcttcgaggggatccccattttccacgtcgagctcgccatcggccagcggctgcggaagggcagcgtcggcgtgtggacggccatctccccgtacctcagtggagtagggctgggctgtgtcacgctgtccttcctgatcagcctgtactacaacaccatcgtggcgtgggtgctgtggtacctcctcaactccttccagcacccgctgccctggagctcctgcccaccggacctcaacagaacagggtttgtggaggagtgccagggcagcagcgccgtgagctacttctggtaccggcagacactgaacatcacagccgacatcaatgacagtggctccatccagtggtggctgctcatctgcttggcagcctcctgggcagtcgtgtacatgtgtgtcatcaggggcattgagactacagggaaggtgatttacttcacagctttgttcccttacctggtcctgaccatctttctcatcagagggctgaccctgccaggggcaacaaaaggactcatctacttgttcactcccaacatgcacattctccagaacccccgggtgtggctggacgcagccacccagatattcttctctctgtccctggccttcggaggacacatcgcttttgcaagttacaactcgcccaggaatgactgccagaaggatgcggtggtcatcgccctggtcaacaggatgacctccctgtacgcgtccatcgctgtcttctctgtcctggggttcaaagcaactaatgactacgagcactgcctggacagaaacatcctcagcctcatcaacgactttgacttcccagagcagagcatctccagggacgactacccagccgtcctcatgcacctgaacgccacctggcccaagagggtggcccagctccccctgaaggcctgcctcctggaagactttctggataagagtgcctcgggcccgggcctggccttcgtcgtcttcacggagaccgacctccacatgccgggggctcctgtgtgggccatgctcttcttcgggatgctgttcaccttggggctatcgaccatgttcgggaccgtggaggcggtcatcacacccctgctggacgtgggggtcctgcctagatgggtccccaaggaggccctgactgggctggtctgcctggtctgcttcctctccgccacctgcttcacgctgcagtctgggaactactggctggagattttcgacaattttgccgcttccctgaacctgctcatgttggcctttctcgaggttgtgggtgtcgtttatgtttatggaatgaaacggttctgcgatgacattgcgtggatgaccgggaggcggcccagcccctactggcggctgacctggagggtggtcagtcccctgctgctgaccatctttgtggcttacatcatcctcctgttctggaagccactgagatacaaggcctggaaccccaaatacgagctgttcccctcgcgtcaggagaagctctacccgggctgggcgcgcgccgcctgtgtgctgctgtccttgctgcccgtgctgtgggtcccggtggccgcgcttgctcagctgctcacccggcggaggcggacgtggagggacagggacgcgcgcccagacacggacatgcgcccggacacggacacgcgcccagacacggacatgcgcccggacacggacatgcgctgaagccggccggagcggggcctgcatgggcgggtctgtgggggggcttggcctgatggtgggcggggccccgcccacagggccgaccccaatacaccagcgactcaaccttg

SEQ ID NO: 578 - DNA, 2343 bp, Homo sapiens
acttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttttcctgcggggtacgtgagcccggactgggacgtggacgctgagagcgggcgcttggactcggtcacagacacggaccctctctagcacagggacagacattagtttccctttgtgcgtggcacagcacagagtcggtgttaataaatgatcgttgggtgagggaatgaatgacagataaaaatacagacaggcccatagcccagactcctgtttcacagttctccctgctgcgaacgggtcgaccacaaaccaccgccactcccaaccaccccagttcatggaattcccccagacggctgcaggctgtgttggtgggtctgttttgaaaagcccttcctggcgagttggtttcagtgtgctgtgtacagcagccgtttaacgttgatggtggaaaggggtgtctaaggtggaggtggttgtgatttcttgtgattggggtcctcccggttcccgcagggcctcaagagctttccgcctccccttacggaggacctctttatgcatccgtggaaggggtcccagaaatcggaaggaggcggctggttggctgtgggatgcatagcctgtgggcgggctccacaccccccctcccatttttgctatcccccctctccccttctgacagcgcgaagtggacggagacggaaatagagatgctgagggctgctgtgaagcgatttggggacgatcttaatcacatcagctgtgtcatcaaggaacggacagtgtgagggagggtggctgccagaaaagggcgggtgggcagccttcttcctccttacccaaggttccatcgtcctcagaactcctttccagctcagctgcttccctactttgtcactagttttttagaatccccttgaggactgaaagaatagaattgtcacagttggtcagaagttcctaaaatgctgtggtaatccttccaagaatgtgaatttaggttgcctgagatgctgttattgtatttgatgatggaagtcccctggttatttatataaatgtttgaggaccccactgcagtgtttccagggatatggtgaccctgaactagttgatcagtaaatctcaatccacctgtaaatcaccaagctctacctgatgtctctcccagaagagaattaggagatgggcctttcccactactcagttcagggactccactctccacactccatccatcctgagtgagtgtaaaacttcgagaaagtgagaaccctaccaatgggttggggccccgacctggattcttatgaagggactcccagaaccccttcccctcccgtcccctcttctgttagtctctctgatgactcctttcctaacctcttctctcttttcttcagggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctggtgagggctgtggagttgctgcctaggggttaaaggtcccatctgaggtttagtgagagaattgggcctgggtcaaagaagggtcagtctctcttcctgtccctgtggaggttcccagagaggggcagaggggaggggagaggaggcacaaagctttgggaagcttggggctgggggagaggctgtcaggggaacctagaacctagcttatgcccccttcccagatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcagcttc

SEQ ID NO: 579 - DNA, 2119 bp, Homo sapiens
gtgagtacccggggacccacctgtccggcagcaccctcccctctcaagagctgggcggtggtgggaggaggaggacgggaaaaccggcgatgcctctggggtttctaggtcgcgcgtctgttaaccgcaaaccgcccaaagttaagatagagcagcttccaggactttcttgaccacagcgattttgattgaagtttagccaccgtcttttccatttttagaaaagctattccgaagtttggaatgatgacgatggtcgtgttatttttaacttcctgatatttgaacggcgaggtgtcagcgaccatccttccgttccacagaagcgtctctgaagtttgggtcgaatgcgcgcgcttggaatgtgcgtggaacccgcggcaggcgcggggaggaggccttggctagggcgccggcgaggttcgagtttgccagccccccaacctggaagagaagggccagcccctcacacccggaagggaagggccggtccccccaacacctggcgccggggtcgcggggccacagggcgagcgcggggtcgcggcgagcacgggtcctctctgatcgctgggccttggcgctggctgctgagtttttccttctttaaggaagtgtggaactggtctcaatcggttgaccaccttaaggaaataggatttacactgtggacagagatgtgtcctttacacttcatttgaaccaatatgcccgtgctcctgtggaggctgagttggaaagtgacacgaagctgcccccccgcaagagagcagtgaataaccctataccttccaatttgaaatcagaagcaaaaaaggctgccaaaatattaagagaattcacagaaataacttccagaaatggacctgataagatcattcctgctcacgtaattgcgaaggctaaaggccttgcaattctgtctgtgatcaaagccgggttcctggtgactgccagaggaggcagcgggattgtagtggcgcgccttccagatggaaaatggtctgcaccctcagccattgggatagctggccttggtggaggatttgaaataggaattgaggtatcagacttggtgataattctgaattatgaccgtgctgtagaagcttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgtaccgtttggttttatgtttcactcagtattctcagaaaatctctttctgtagaacattctgtccctgatatcaggttcctaagaacctactaagcctccttcgtagtttcactgacttcacattcttgtgaaaaggtcatgctaccttgacatttcctctgtacagatttcagggaaaaacataatttgtcctctgtgattgcatttctccaaggatggaactttgttgtatcaataatacaaataatatgtgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagtaggaccttatctcaataataatatatgaataatagttgcagatactgacgcctttgtatgtcaggccttggggcaccgagggatctgtgtgcattgttcatggtgttccacagcacctttcagagttggtatgatgcctgtttcatggaataaaaactgaagcctag

SEQ ID NO: 580 - DNA, 2269 bp, Homo sapiens
agtgcatcgggcggtgcgggagaggagaggaggggctccgggaacctcggccagccccggcctccggcggctcctgccctcgcggtttttccgtctgcgaaatgggcgcggtccccagaacctgccgagagcagcgagtgtgcgcctgcggggctcggcagaccgcctcagcttcccggtccccaagggagcactgagccctcctccgccttcacaccaggccggcgcgtgtccctggcgcccccttccctaaacccctcgcggctccctcaggacaaccccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccagggtctgggtccgggcccccggggatggggttcctatgcgtcccgggtgatccgcgcggaccttccgcacttctctgggtgggtggccttccctgagaagggggcatcccggagagcatcccgggcactcagtcgcctcctccccagcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgcccccaggccgcctgccacagcgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccacccgctctggccccagtcgaactgggggctagccacctcctcgtccagcccccaaacctccccttcctttccccctcctccgggggccaaggacagggtggccttactcagtaaaggtgtttcctgc

SEQ ID NO: 581 - DNA, 2925 bp, Homo sapiens
acaaagtctatcaaaggtttttggctgtagtgccatctctaacggacagttcagaatctgtatctgggcaacgaccaaacacgagtgtggagcagggatctgggttacttagcactttggttggagagaagtctgtgactcagagatgggagagaggtgaaatcagcaacttccaatatttgatgcatttgaacactttggctggcagatcatataatgatctcatgcagtatcctgtcttcccctggatccttgcagattatgactcagaggaggtggatcttactaatcccaagacgtttagaaacctggctaagccaatgggagcacaaacagatgaacgattagctcagtataagaagcggtataaagactgggaggatcctaatggagaaactcctgcataccactatgggacccactattcatctgcaatgattgtggcctcataccttgtaaggatggagcctttcacacagatattcttaaggctacagggtggccactttgacctggctgaccggatgtttcacagtgtgcgcgaggcctggtattcagcgtcaaagcacaatatggcagatgtaaaagaacttatcccagagttcttttatttaccagaattcctgttcaattccaacaactttgatctaggctgtaaacaaaatggcaccaagcttggagatgttatccttccaccctgggcaaaaggggacccacgagaattcatcagagtccatcgtgaggctttggagtgtgattacgtgagtgcccatctacatgagtggattgacttaatcttcggttataaacagcaaggccctgctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggttcttatcccaccaacctggaataaaacttttgcttggggctatgcagacctcagttgcagactgggaacctatgagtcagacaaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcagggcccccttagccacccccaccccaatcccattgaggtgcggaattacagcagattgaaacctgggtaccgatgggaacggcagctggtgttcaggagtaagccgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatcccc

SEQ ID NO: 582 - DNA, 2322 bp, Homo sapiens
aggcagagtcgggcgtccgcgtcctcccggccagctcgaccgtcttctctattgggggcccattcaggacacaggggagaagggatgatgtataaacccatggagttgctcactctcctcttacctccttgaggcaagtctctggtactcaggctggagtgcggtggtgtgatcttggctcactgtaaactcaagctcctgaactcaagcaattctcctgccttggcctcccaaagtgctgggattgcaggtgtgaactgccacacctggctccccgactattcctgtatcagaaatgtaactcacccactcaccaccagcccacactctgggttctcctatcactccactgcctgctcctcggctgatcacaatggaagaagagatcatggcacttgtcattgacaatggctccagcacatgcaaagctggctttgctgggtatagttccccgagccatgttcccctccatcactgggtatccctggcaccagggcatgatggtgggcataggccagaaggactcctacctgggtgatgaggcccagagcaagtgcagcatcctgaccctgaaagtgccccgtggaccaccgcatcatcaccaactgggatgacatggagaagatctggcaccacaccttctacgattagctgcacgtggctcccaaggagcacccagtgctgctgcctgaggccccgctgaaccccagggccaacagaaagaagatgactcggattgagaccttcaacaccccagcaaggtacacagccatccaggctgtgctgtccctgtacacctctggttacaccactggtattatcatacacagctgagacccacacggtgcccgtctacaagggctatgccttcccccatgccatcctgcgtctggatgactggcacctgaccaaccaccccatggagatcttcagggagcccagctactgcttcaccaccacagccaaacgggagatcttgtgcaacatcaaggagaagctgcggaaatggccaccacagcgtcctcctcctccctggagaagatctaggagctgtccaagtggttccagtgtctggaggcgctgttccaggcctccttcctgggtatggaatcttgtggcatccaccaggccaccttcaactccataaagtgtgatgtgcacatccgcaaggacctgtttgccaacatggtgctgtctggtgacacccccgtgtacctgggcatcacctacatgatgcagaagatcacgaccctggtgcccagctccaagaagatcatcaccttccctgagcgcaagtccttgtgtggattggcagcaccatcctggccgccttccagcagatgtggatcatcaagcaggagtaggatgaatcaagcccctgcatcacccactgcaaatgcttctaaatggactgcaagcagacgcgtgtcatgtgcttcatggattaatgcagaagtataaatttgcccctggcaaatgcatacacctcatgctagcctcaataaaccagaataagcctttcaaaagaactggtccttgaagcttgtatatcagcaccggattgtagaacttggtgctgattttgactttgttaaccgttcccttggtatttgtttaataccctgtacatatctttgatttatacccttagtacatgtggctcagtaacttcatggctgaggtgaggacatgcttgtgggagggaagtctgtggcttggtgggtctgtgtgacctgcagtctccttatctgtgcaggtactaaggtgtcagagagctcagtgttccaggattttcctttttttttttttttttttgagacagagtttcgctctagttgcccacactagagtgcaatggcgcaacctcggttcactacaacctccgcctcctgagtccaagtgattctcctgcttcagcctcccaagtagctgggattacgggcatgcgccaccacacccggctaattttgtatttttagtagagacagggtttctccatgttggtcaggctagtctcaaactcccgaccttaggtgatgcactgcgcccagccattccaggatttttctagagcctggcaagagctcctgaaccagtttcatttctgtcttgctggtctattagtgttaagtcttgagctagaagcggtttacatttacacctgtaaatttattcattcttttaatttatgtaagttttttgtacataattctcaatttttaaagagatgaccacaaattttggttttccactgttatttacataaggaaaaataaagtgctgcagtaaaccaaaaaataaatataattcgctctaacctct

SEQ ID NO: 583 - DNA, 2086 bp, Homo sapiens
ccggggggcgggggtgcctgtgtccctgccacagatagcgaggtcccggggggtctccctgtgtccctgccacagatagcgaggtccctgggggggtccctgtgtccctgccacagatagcaaggtctcacgggggcgggggctgcagtccgacggtctgggccacgtcacgcccacacttgggtcagagccaggcaacacccctaaagtcacaggaatggggagctgctcacccccaaaggcagcgggcgaaacatggcggagaagaactcctggtgggcaaagactgggtcacccttggctggccacgccccggactggccacgccccattggctggccacgccccctcggtcacctgcgctgcgccacggccgactcctgggcccagtgcagctgcccagcaggggaggcctggggtgggcgaagccgggctctgagctgtgttaatgcattaacttagagtccgcatatcacagtagagtgctgtttataagaaaccaaaatgtttttaaagttgtgctaaaaataagttaacattgcagcagatgtttttctccatcagacatttccctccatggtggtctggcagacgtgggccgggcatgggcagctgtcacccagcccccggggacttagagctgcggggcacggtggggcgggctgcagggagcagaccctgctgggccgctgatccctgacccagcgtccccactgtccccgccaggtggtggcctctgccatccccgacgaccagggctggggcgtccgccctcagcagccacaggtgggtttgcggcccctcagacccctgcctggcctcacccagctttctgggaaagaaaatgctgcacaagctctgagccctcctggggctgcgaagttcctctgatgggaggtgtggggtggccatcccatccctgtgtaagacctggggaaaccactcttcaaggttcaggaggagggagggcggcccccgacccttaaccagagcgaggttgttgctttgtgtccacagggaccaggagcgaaccatgatgccaggtccctaatcatggactccccaagagctggcacccaccagggccccctcgatgcagagacagaggtcggtgctgaccgctgcacgtcgactgcctaccaggagcaggtgcgtgggcctgggcctcttcccctgctgggggtcggtgcttctgctgcctccgcagactggggaccacaatgggaccaacatgagggtggagggagcagctcactggggggtagacggggccgggctcacccgtggtcctggcccagcccagccagatgggaggatacctggctgtgcccgaggcgagtgggcattggccatcaggacaggagagaggtggtgtccagtggagacatccacgtagccctgcaggccctcagcccccaggaccacctcagtttggccattgcccctcccctcccactggggtgcgagtgaccaggagtgacccagctggggacaggcgggaggcaggacagctctggaggggccccaaggctcccgccccccatgggggcccagcagcgactccatcccccgagtcctcccggacaccccggcacctggggagaggcggaggaaggcaggaaccccagctgctcccagggtggcagccgtgggcgaaggctctgctgcaggatccgggaggcccagagaaggcacctgcatttcacgctgagcgcatctgaggatgcgatcaggaagcagccccggcactctctctttatggatgcccacttccagtttaaccgtggcatcccgggggcaagggcgccctccaagctgtgcttcactaattccctcagggtttggaactatttgcccagttcccacgatgggcctttaagctctcgtccttcctaacctaaggcaacttcaaccatctgataaatctaataataagttacaatcgaggccgggcacagtggtctgtaatcccagcaccgtgggaggctgaggtggaaggattgcttgagcctgggaggtggaggctgcagtgagccgtgacagtgccactccactccggcctgggcaagacagcaagaccctgttt

SEQ ID NO: 584 - DNA, 2212 bp, Homo sapiens
atgaaaatcagtttcatttctgtgcctttatatataagcctttgaatcttgttgctgggtcgtatggtaagtccatttttagttttaaggaacaaactattttccagagtggctgcagtcatttccattcctgccagcagtgtgagtgatccagtttctctgcagtatcaccagcgtttggcgttgtcaatatttcttccgttaaccattctgataggtatgtagtgatgtcttgtgtcttttatttgcatttctctattggctaataatgttgaagatctttttgtgtgcttatttaccatctggtgtcttaagcaaaatgtctctgcgtgtcttttgccattttttttttcaagacagagtcttgctctgtcgcccaggctggagtgcggtggtgcagtctcagctcactgcgaccttggcctcccgtgttcaagcgattctcctgcctcagccttccaagtagctgggactgcaggcatgcaccaccacaccctgctaattttttgtatttttaatagagacggggtttcgcaatgttgaccaggctggtctcgaactcctgaccttaagtgatccacccaccttggcctcccaaagtgctgggattaccggcataagccactgcgcccggccatcatttgcctattttctaattgatttttttatggtgaattttgagagcccttcccatatttgagatacaagtcctttgtcagttttgtgatttgcaagtattttcttccagtccttggcttgccttttcctcctcctcacagaggagatgtgttcggttctgacaaggtccagtttacccattttcccttttatggctcatgccttgatgtcaggtgtagcatgttgggttcagtgagtggtgagtggtgttctactggaagaacgtggtcgctctctcctccccgccaccccacgcactcagcagggactatggatgccttctagttcatccgtgcatttgacggcatccatgtccaaggcctggaaacatgcttggctcacccagcaggggcatgacagcatgaaggccagaaccaaacccccctcagtcaacgtttcacgtccccaaacccgtctcagggtaacacttgacctacagtgtcaagatgaaattgactctgcaaccacacaggtgagtgaaagaaaacattggcggcagcaggttggtttccacagcccggccccaggcccaggtcatggtgcttagaggaggagcctcagctgagaatgaagggtgccagggatgcttctccatccctgtcatgggcagctgctgcggttggatctgccctgggaagggcaggagagggcacctcgatggtcgggtgcaagaagccactgggtcagcagatcgcccggcccttccccacatgttcaacctcttggcctctgggctgctttctccacctggaacattcttcctccagaaagccacgtggctcactctctgacttcctccaggaagtgagcttactaaccgggccgtccctgaccactcaggataaaagtgtgcacgccctgtcccttcctcccccaactctgccccgtccttctgatctccccgcacactgctggtaactctcttatcatctgtctccccaagtgtcagcttctgcagggcaggggcagcatctgtcttgcatgctgctctaggccctcacacacagcaggtgctcaataaatatctgccgactggaatggagtgagaatgccaggctcaggtttctggtatgctcctaaattggtggccttgggccagtaacttgacccttctaagcatggattctacatctgtcaatttagccagtgagtctagcccttgggtgtggaagtcctgaacaccaaatgtgtattgcacggcccctgtgtacaggtgctaggtgccagggttgcagttcacgtgtcagacgagcagaagatcagagagcgaagcccaccttgtgtgcgcaggcgaaagtgtggatgctgtagggaggtgctcattcacgtgggacccgctccatcttccgtggaacagggacacttctcatgcctcccttcttactctgaggaaaggattcagagaaaggaatccaagctgggtacagtggctcacacctgtaatcccagcacttggagaggccatggtgggagaatctcttgagcccaggagttcgagaccggcctgggcaacatggtgagacctcatctctac

SEQ ID NO: 585 - DNA, 1865 bp, Homo sapiens
attttatttcaggaatccatcaacatcctttgcagctacataggcaggaaaatctagaaattgtaatttatatagaattttaaaactcttcaattacaatggatagaggggagaaaatacagctcaagagagtgtttggatattggtggggcacaagttttttgcttattaatatcattggtgcaggaatttttgtgtcccccaaaggtgtgttggcatactcttgcatgaacgtgggagtctccctgtgcgtttgggctggctgtgccatactggccatgacatcaactctttgctctgcagagataagtataagcttcccatgcagtggagctcaatactattttctcaagagatactttggctccacggttgcttttttgaatctctggacatccttgtttctggggtcaggggtagttgctggccaagctctgctccttgctgagtacagcatccagcctttttttcccagctgctctgtcccaaagctgcctaagaaatgtctggcattggccatgttgtggattgtaggaattctgacttctcgtggtgtgaaagaagtgacttggcttcagatagctagctcagtgctgaaagtgtccatacttagcttcatttccctaactggagtagtgttcctgataagagggaaaaaggagaatgtagaacgatttcagaatgcttttgatgctgaacttccagatatctctcaccttatacaagccatcttccaaggatattttgcatattcaggcggggcatgctttacacttatagcaggggagctgaagaagcccagaacaacaattcccaaatgcatatttactgcgttacctctgatgactgtagtttatttactggttaacatttcctatctgactgttctgacacccagggaaattctctcttcagatgctgtagctatcacatgggctgatcgagcttttccctcattagcatggattatgccttttgctatttctacctcattatttagcaaccttctgatttctatatttaaatcatcgagaccaatatatcttgcaagccaagagggccagctgcctttgctatttaatacacttaatagtcactcttctccatttacagctgtgctactacttgtcactttgggatcccttgcaattatcttaacaagtctaattgatttgataaactatatttttttcacgggttcattatggtctatattattaatgataggaatactaaggcggagataccaggaacccaatctatctataccttataaggtgtttttgtcatttccattagcaacaatagtcatcgacgtgggcttggttgtgataccattggtaaagtctccaaatgtgcattatgtctacgtgcttctgttagttctcagcggattactattttacatacctttaatacattttaaaataagattggcttggtttgagaagatgacttgctatttacaattactatttaatatttgcctccctgatgtgtctgaggaatagatgtcggaagtgcaaactcttaaaaaattggccttctaaaaaacatatatcagattccaaatcaaggttaaacatatgatagaacattcatggtgaaattcctatggtaaatatttttttctcaaatgaaataagtaatgtatacaaaagtgcctaagacagtacctggcttcagagtcactaagaaattgctaaaagctctgcttcgcatggtaaaaaacttaagtcctggtttgcgtagcttgatagagtgattatacaacttccattctctcactttttttttctgtatcccaccccttttctactgaatttgtggggatcctataataaaagtgaatgactaaaaatttt

SEQ ID NO: 586 - DNA, 1709 bp, Homo sapiens
gttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttgtaggctgccggattcacaaattgtttgttgcttaatgaaactcctttaagtttaattcagctgaagtttttcttttatcagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtctgaagcatcccacagaatgatcctactgaataactcccataagctgctggccctatacaaatccttggccaggagcatccctgagtccctgaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccggaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatc

SEQ ID NO: 587 - DNA, 2235 bp, Homo sapiens
cagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggatcaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagat

SEQ ID NO: 588 - DNA, 2546 bp, Homo sapiens
taaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctccaccacacatagtgtactttggaagcacaacgtccaggctggtaccgcagcgccatgcccattcctcgcctcgttcataggacacttcactgccattttctattcacataaaagaaaaataaatgtggaaatttcatccttgg

SEQ ID NO: 589 - DNA, 2248 bp, Homo sapiens
ttgcacctagacacttcttgaaaggagacactcagtttcacaagtgagccctcttgcccagcacacacctatggctggctgggcaaggcgctcaggcatgcaaccatgggcaccaggcaatacccatccatcacccatctcactctccccagtcctcaggcagcagcttttccaccccaggaatctctgttccttctctgtctgcctctccacagcccgtgatcccctgcttctggctcctaccactggacagtcattgtggatagagcagcctgctgctctcaggaccagagaagggaaatgacttctccaggcagaggcagatctgagtctagaacccaggcttctaaatttctaggccagtactactgctctcaaaagagattaactgggattaagtgagatgacgcatgtaaagatgctgtgtaaactgtaattcttaataccattatcacgcattactagaatcatttcattatttctgcttcctgggggaaggatgcagaaggagtctgatgctcaacatcccttacctcctttcgctgatggccaaagcaaaggagagtcctgggagcccacaagatccaggcagaaggagatgggtttggggctggccccatcctggcccagcctcttaacctcttcttaccctggatgtgtgccctatcttttctcccacctccttcctcctaccacccagccctatccattctctccttccctctccagcctgctgtataagtaacatgcgggtcataccttgaacccccctccgcccccatgctctctgtggcctccatgccttcaagacttctgtctgtatctatctcacactgcaccaagcacccactgtgcaccaggcactaagtctctagcctctttctcccttctgctcccatccaagaaagacagtgtataaggaacatctctgtaattgtgtcccctctcatctatgctctttcctgtcttccttgaccaaagctctctttgaggtccaaaaaaggctgccctgggccatatgtgctatggagaggactctcccaaacccccaatagctagtgacagccacttggcctcactaccagaagaagggtggagtcagaaaccaaagtgacctccagagctgtcctcctggcacctgagtgtccttgctctagaggttcaaaggcagcaaggcagtgagctatgagcccagcatggatgtgtctcaggcacctcatccccaccccacctcaccccaacaaactcctctagaagaagccaagaatttctatgtctgtttcactttttggattgcatctccccaaaaactaaatgtgaaatccctaccatttctagcctctattgcccagattggagtcagaggtcaaaaaaggattccaagtgatggaactccaggggtggagggaaattggcagttcctggcatctcttgtgtaccagctgctgtgctgggtgccttgcatgcacgggcttatctgatcttcctcaaacttcagataggttagggaaggacaaaggcccccagccatgaagggttttgctatttccaaagcttccccttatcgtcccctgtgattatctcccaaccccgtgacaaaggtagagcaaatattgttcttcccattttacagattcagaaaccaaggctaagggactggtctaaagtctcacaggtagtatatggtggagccaacacttgaactcagacctttttacacaaaatcccatgatttttccactgagacaaatcctaggctcctgggaggccctggcagaagccagaacacatggctgggcctttccagcccaacccactgtcttgcagtggacggagagccttggcgagggcagcagggtagagaggacaaagaatgtggggctggtttctgccctttaagagcacccggtcagtcagagaacagagatcacacacaccaaaccagacagaggcagggcagcatggagacaggtagacagacctccaggtccctaagctggggacagagaaggttctgagctgtcccatactcccactttgtgccaaatgactttgcacctgcaaatggtgcttcaatgtcgttttgtatctttaagctgtgatgttgtatatatacaatgcctcccagctagactgtaagccctttggggacaagggctgcttccagttcttggatggcgttctcctatctaccttccttcaactgctctgcatataataagcactcaataaatgctcatttgccaat

SEQ ID NO: 590 - DNA, 2960 bp, Homo sapiens
aaccacgggagttgtcgctgtctaggagcatctgaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgcggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtgtgagaagagctactaaggccttaggcattggctggcccacagagggtgtgagacaagctgccaccagggactgagggaggcaggatggagcacattgtctttgctgtgtcatcaacatggcagaaggcacagaagaatcaacattctctgtagctgataccaaaactgatagcaaaacccatcctttattacctctttttttttttttggagacagtgtctcactctgtcacccaggctggagtgcagtggtacaatttgggctcactgcaacttctgcctcccgggttcaagtgattctcctgcctcagcctccccagtagctgggactacaggcacgtgccaccacacctagataatttttgtatttttagtagagatgggttttcaccatgttggccaggctggtctcgaactcctgacctcctggcctcaggtgatctgcctgcctctgcctctcaaagtgctgggattacaggtgttgagccatgcgcccagcaatcctgtatgacctcagaggtgattgtattatggcaacaaagtcaagaagggagtttggaagttggtgtctcttactattcacagtctgtgccctcaggaaacttccttaaccctgcattcctcctcctcatgcctagctgaccttcacctagacctgctgtccagtgcttttcagccacacttatctgatagcatgaactggctggaggacagcctcttcgtccctcattgattctcatcccaatatggtagcaccagagtcttcaacctcagatcaaagagacaacctgatgacttttcatttcagtgaaagccacatcacaaatttctggataatttaatttttctagtggcctgccatttgtaatccaagctggtaactctggcccagagttatttcaagaaggaaagtctgaccttcacctaacttaaaattcctgggatgtagatctttgttctatgggtcatctcttacttgaccagagttaggatataccagctcagcagaaagcaggtcagtaagctttgaaatgcagcatgaacctgagtggtgggttagctcaccacatctcaccattaggaaaatggtcaaaagcaggagacaaccccgcatcccctcgtaattgtgttacctgccttttctttcttcagttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattagggtatgttggacactaggggccctcagatgtggtattgagctgattaattagagccatgaggagactctgaaggctacttggttttctgtgtccaccacccttaatctctgtgatagaattggcaaataaagcttagacttatg

SEQ ID NO: 591 - DNA, 3274 bp, Homo sapiens
gtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggaactgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccaaggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcacgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgtctaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgttggggttttgccagggaagtaaaaggagctgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagcgcctgcctactgggcagctcatctgtccacttattcgtattaaatttgctttttattt

SEQ ID NO: 592 - DNA, 2459 bp, Homo sapiens
aagcaaacaacttcaactttccatgagtgctagccagccctgggaggctccgctgccagaaggaacgtcaaggggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcgacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcatttgagaccctgcgctactgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 593 - DNA, 1743 bp, Homo sapiens
ctaagaagcagggtgagcccacaaggagcaatggagcagggcagcggccgcttggaggacttccctgtcaatgtgttctccgtcactccttacacacccagcaccgctgacatccaggtgtccgatgatgacaaggcgggggccaccttgctcttctcaggcatctttctgggactggtggggatcacattcactgtcatgggctggatcaaataccaaggtgtctcccactttgaatggacccagctccttgggcccgtcctgctgtcagttggggtgacattcatcctgattgctgtgtgcaagttcaaaatgctctcctgccagttgtgcaaagaaagtgaggaaagggtcccggactcggaacagacaccaggaggaccatcatttgttttcactggcatcaaccaacccatcaccttccatggggccactgtggtgcagtacatccctcctccttatggttctccagagcctatggggataaataccagctacctgcagtctgtggtgagcccctgcggcctcataacctctggaggggcagcagccgccatgtcaagtcctcctcaatactacaccatctaccctcaagataactctgcatttgtggttgatgagggctgcctttctttcacggacggtggaaatcacaggtatggcccaatcctgatgttgaccagctagaagagacacagctggaagaggaggcctgtgcctgcttctctcctcccccttatgaagaaatatactctctccctcgctagaggctattctgatataataacacaatgctcagctcagggagcaagtgtttccgtcattgttacctgacaaccgtggtgttctatgttgtaaccttcagaagttacagcagcgcccaggcagcctgacagagatcattcaaggggggaaaggggaagtgggaggtgcaatttctcagattggtaaaaattaggctgggctggggaaattctcctccggaacagtttcaaattccctcgggtaagaaatctcctgtataaggttcaggagcaggaatttcactttttcatccaccaccctcccccttctctgtaggaaggcattggtggctcaattttaaccccagcagccaatggaaaaatcacgacttctgagactttgggagtttccacagaggtgagagtcgggtgggaaggaagcagggaagagaaagcaggcccagctggagatttcctggtggctgtccttggccccaaagcagactcactaatcccaaacaactcagctgccatctggcctctctgaggactctgggtaccttaaagactataaaacaaaacaaaacaaaaacatcaaaccaatgaaataaaataaatcatgtctcctgctagaatagtattggatacctgactaaattacacaaaatagaccataataggatagcactgtgaatacatccttcccgatcactgagtcacagtgacccttggctgctgcagttctcgtctgcaaggttgaagcttgacgtgtgatggacatgggtgggctcttggtccaccccaggctggggcctgcgccaagcatgaactagctgggaccagtggctgacagaacacaggacttccctaagtacccgtaggtccgtggagcaagacagagcagagttgccatgtcaacacatggggaatgatatgatagaaacaatctttatgactaaaagaaactcatcttcttcattaaaaaaactttggtgtcctt

SEQ ID NO: 594 - DNA, 1968 bp, Homo sapiens
aggggttggccggccggcctggagccgccccgcccacggccgaggtttcggtttcccttgggagccccgccctgtgtcccggggagccggaggaggtggagatgaatggcgggcgcagcgaccgggagccggacccctgggaggtcggagcttgtcgagggatgcggctggcgctgcccggagcatggcgaccgcgtggctgagctcttctgtcgccgctgccgccgctgcgtgtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagccccccacgctggatcctgacacgatgcacgcgcgcctgcgcctgtccgccgatcgcctgacggtgcgctgcggcctgctgggcagcctggggcccgtgcccgtgctgcggttcgacgcactctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaat

SEQ ID NO: 595 - DNA, 2758 bp, Homo sapiens
cacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaacccccctaaatccatagagttttcaaaatgtgaatctttggaagccttgagttcagaatctgctgctctggaatatttcccttcgatcttatctcagtcacttcgtttttgagaagagtgatgccttgggcatgctttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaaccgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaagg

SEQ ID NO: 596 - DNA, 1949 bp, Homo sapiens
gaagaaaatgggtgtggaaattcttggcttatgaagaaggctgttgtcacattgatttaaatgaaaaacggatgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacgaaaaaacctaggagataaatgtagaggtattgacttttcgtatcttttatcttcacactgaaacaagagctatcctatttgattattaaagtgagctatgtgtt

SEQ ID NO: 597 - DNA, 3270 bp, Homo sapiens
gttttcaaacggggaacttagaaagtggcagcccctcggcttgttgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtgatggggaaatcaaggcctggagagatgacttatccagggtcacgtggcgagacagggacagcaccagaaccagacccgagatgtccacgtcaaagtgacatgctctgagaggcagcacacacagaataaccctgcatccaaattccaggaagctcttaggggtcatccagctgggcctaggggtgcagggtcagtgctgaggcctgggcagggccgctagcctccctgagctttctggcttcaggctgggaggcacagttcagggtggactgtgaccccttggcctagaatgcccttagctctgctctctagtggctgtccccatagctggaactctgttttggagtggcaaaaccagttccacctgctggtaggggtaggttggctcccaacacatccccagcaggcctctcttgggctcaaaagccaagctgtgcccagccacgtctccaaatgcttcctggcccccatgcagcaactgcatttagctgccttcccagaatttcctgcatgctcacacagcccttccctctggggcccaacaatgccacagcctgttctatcaatcaccagctgttttcctttgagcagtctccttttacttatgcacatttacttgaaaaagaaacttcctattactatcctaaatggaaactcagaatcacttgctataattagaaagtagctacaaaaataaacacaatgaaaccgatcactgttattacaccctaacccgcttttacctgagacaggccctgagcctgaggccgctggtagacttttgttaaaagagagagagacagagacagagaaataagcattagagacctgcaatcaccaagctgagacttctctttgatttactcagaaggactggaaaatgttgtcctgcaaaaggaggtaagtttctcaccacgtagcgctgatcatcccgtgttgcccgtgcgttgctgcagaccatctggggtcttgcccaagcaccctggagactttgctccctggtttcctggtcaccaactcgagtgttcagccctgtgtgctctccagctcctaagtcgtgggcctggtttcagctttgattgcccactcttggctttcaacccgtaggctccggctcctgacgccacaccctgatatcaagaccctcagatggagcgagcgttctgggctggtcgaagcctgaagccgcagtatgtccttgagtgggtccccccctacccatctagctgttgcccccatggtaagatcaagaaaatgccctcccctccaaaagtccccacgccgagccctcatctgtcagctcccaggctcggccccctcactagctccaggctgggaggcacagttcagggcagactgtggcccctcagcatagcatggacttagctctgctctctagtggctgtccccatagctagaactctgttttggagcagcaaaactagttccacctgctggtagggctaagttgactcccaacatgtccccagcgtgttggtgttgggaaccttgatctagctgctcgttttctcagtaaccaaagatccctggcactcctacgatgtctcaggccttatctagagctggggatacagcagtgaccaggacagaactggtccctgcctcacggaagtgaagtgtcaggaggccactcccaaagcaaatggaagctgggacagaatgatgtcctcagccaggtggtcagggaaggcttctcagagggggcgctgttcaaagaatcacagagcatacaaaggagctggccctgggagcacagagaggggagaattttaggcaaagaggtagcaggagcacagccctgaggcaggaaactacccccccaccaccctcggcatcctcagttctggtttgcacccagaaagggggtaggtccaggacacacccggactgatgtgtcacactggctgtgccagctgagagagtgggctccaggcaccactaacagagaagccttgcaaggcaggtccatgcaccgcccgcctccagttaccactcattgcaaaggaaatgagctgggagcctgtgtgtgggccgtgcagacccttttggttacaagccacaaaaacccaggttaatctgatgaggaaggaatttattatctgtaaagtccaggagcaggccagctttacaccaagcaggatccaaggacccacactttgtcacctcatatctctctctctctcccactttcgctttctttgtctcttcttagttctgctttcctccactgtgccttcgctctcagagagagctctcccctggcagtgacaagatggctgcagcagctccagcaacctcagaggactcccccatccagggtccttgtgagctcctcatctgtaggatgtgcagtaaacactcacgtgtcctttcctgaggagcccagtggctggggtgggggctgaggggcagcccctatgcccacacagtgcagcaaccttggttagctcacccatcagggcagacttgggcagaaatcatgtcttggcatattgttttgtaatctgctttttaaattgtcactatatattatgagcatttccctataatatacaatattcttccacattatgtttaatggtttcattgtattctaatgcatattctatagttattttaaccaccccacaatgttgcaaaatgtccttatttgggacaacactgctgcaaacactttgacccatatgtcctttttgtgtgcactcttatggcaacttctaacggtggcatttctgaatcatagacacttttttgacttctacatattttatttttttagttgacaaaaactgtatttatgaatcataaacacttaatgattttgctatt

SEQ ID NO: 598 - DNA, 2484 bp, Homo sapiens
ttcgtgaccaacaccccaggcaaggcttggggcccccgtctgctgctggacagtaagtcctggccccgtggcagtgaatctgtggggtgctctgattgtgggcactatggaagctaaaccccatgctccaggtggggtggagggccttcagaggactcctggacagtgccaggctctaggctgaggtgggggacacaggagaaaccaggccaggcccatccctactggagcttctccctaagcagtggaggctcagccactgtgaggaggtaggcaaggccctgcagaaagaggggtgtggaaatctgggggctcccaggaagggccgctgctggagatggggttcttaccaggatgggctctgaagataagcagggaggatttgggagggcagagatgaggcccagagcttctggcagagggcatggcctgcacaaaggtctgggggccggacagcctgcacgtgttctgggaagcgggaaggagacacaggccttgtgtttctgaggcccaactttagactgtgccctgctggggaggtgccagggaatgtctgaggctgggcctgaccctgctccttaccccatgggagcagcagagccatgaagaagaagttagtggtgctgggcctgctggccgtggtcctggtgctggtcattgtcggcctctgtctctgactgccctcagcctccaaggaacctgacaaccatgtgtacaccagggctgccgtggctgcagatgccaagcagtgctcggagattgggaggagggctgtcggtggcagtgcctggggagatccgaggctatgagctggcacaccagcagcatgggcggctgccctgggctcgcctcttccagcccagcatccagctggcccgccagggcttccccgtgggcaagggcttggcagcagccctggaaaacaagcggaccgtcatcgagcagcagcctgtcttgtggtatgtctgtgggtgcagccccctgacacaggcagggcaggcacagcccaaggaccttgcaggccgtagcagcagtggagcggccctctgccttcaggaccctgcgctgataatgggatgaggagatacagacccttcccaccacatgtggggacacattctgagcatggggtcccagtggccactgtggctggccatgtgtcctgagtggcaagggacactaggaggttcccggaagggacactaggaggacgagcgctgagtgacagggccacccacccgtgacaggcgctgcccctgctttgtgctggtctcctgtgtgggcaggtgtgggggttggtctagctaagtccaccccacctgctgcctcacatgagccccctctgccccagtgaggtgttctgccgggatagaaaggtgctttgggagggggagagactgatcctgctgcggctggctgacacctatgagacgctggccattgagggtgcccaggccttctacaacggcagcctcatggcccagattgtgaaggacatccaggcggctggtgagtgggtaacctcaagggcctgggtgaggaactctgcagtggaaaccctgagctgtagcccagagccatggggtcctcctgtcttgcctgagcctgcaggaagttcctggtggaggagggtcagtgactggccatgtgggtccacagctcctgcttatatcaaaaccaagagaggccacacagtccaggagagcaagtccctgttggggtaaatgcaggtgtaggcaagagccagggctagggaagcgctagaatacagcctgaagatccaggaggacttcttggaggaggtggtggctgggctgcagataacttcgttaggcagagggaggaagggattcctagcagaggaacagctgggctaaggcccagtagagggggctttgattcaccaagagggttacaagggatgagggttgctttgagagaggcatggggaaggggatttgtggagcaggggcctggagcttggctgtggctttcttcaggtaatttttgtcactgtttcatggaggagggtgattagcgtgtcaacctttaccactgaggctggaaattggcatgccaataccctgtctgtctggagctgactccaggagaattaagagcctccctccctccctctatccattcatcgtgaggagaagaggccaagcagcagggacaccggcaggaattctccagttagaaaaggccctctgagccaggtgcggtggctcacgtctgtaatcccagcactttgggaggccgaggtgggtggatcacctgaggtcaggagttcaagaccagcctggccaacatggtgaaaccctgtctctactaaaaatgcaaaattagtcaggcatggtgggttgtgcctgtaatcccagctacttgggaggctgtggcaggagaatcgctagaacctggggggctgaggttgcagtgagccgagattgcaccactgcactccacagagtgagactccatctc

SEQ ID NO: 599 - DNA, 2594 bp, Homo sapiens
agagttgctttccagctcctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagaagcaagcagcagcaacagctcaaccttgaccgctcaccacccagaccctgggaccctggagcagtgcctcaacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcctctctcaagatagtccctctgtaatgtatcctgttttaacctttcttctaggcaccaagggaggtgcacaagaaactataagacttagtctcatcatcaacattttcagaagcaagtgcataaccttctcaccaaaaccaggttatctgctcctgtccctggcttgagtcctgggcttaactgtcatttcagaatctgagaatcagtcaggtatggtggctcatgcctgtaatcccagcactttgggaggcagaggtgggcagatcactcaaggtcaggagttccagatcagcctggccaacatggtgaaaccctgtctctactaaaaatacaaaaattagccaggtgtggtggtgcacacctgtaatcccagctacttgggaggccgaggcaggagaatctcttgaacctcggaggcggaggttgcagtgagccaagatcatgccactgtactccagcctgggcggcagagcaagactctgtatcagaaaaaaaaaaaaaaaagaatgtgaggatcaggtgggcatggtggctcatgcctgtaatcccagcactttgagagactgagacaggaggatcactttagcccaggaattcgagaccagcctgggcaagatggcaagaccttgtttctgtttaaaaactttttaaagttaaaaataaaaatgtgagaatccccttgacactcccaccatcttcacccccacctcaggtccttctccagctctccttctggcttcatcctgtcttccacggctctcctgtcccacctattctccctgccggtgcccaagttttagccttcactgccttcccctagaacacgccagggatattgcattctgtcctcactgtcttgaggatcttcctccccggctcatcactccccatgggcagctgccagggtaggcgctgtcaccttctgttgacaacagtcagtagctcctaaggactaaaactgttcagcccagcattcagctctttggaggagtccatctgtcccccagcacatccaggagtaaggattccgactggtccactcctcatcctggtgtcttcagcttctctgctgccatgttctttgctgggatggctgcttcccaactccacctccagaatcaaggatattcctccaagcccagctcgaatgcttgatctgcctggagccttcctggtcatccttgggtgacctggagctggtgctgttagagcacttctgctctgccctgatgtgcagttgttgtgaatgggccactccatagtttatccttcctcacacccctggggcatagtaccctattcaagtttgtccaatgagtgcatgggtgaattaatgaatgaatgaacaaatgagtctttgccctagacaacttaaggtcctcactctgcattaggagcctccatttttctccagatggttgaaataaccagcctctgaaggagccaatggtttggtcactgctctctcagcaaattacagtcactgtcacttagcatggagagtggacgttgcacatcactgtgaaaccttgcagaggaggagagggcaggttcatcagaagaaagaaaggacaaaatgactccttatgaagcattttgtgccttctgtgagaaaacatgtatttagatcagataaactctagtcaaaatacaaaaaggaaaaatgaaagacctctgaaataggaacaatctcttgaagaggcaaatgactcaaaactgctcagtggctctttcagaaaatctaagtaaagttccctgacaacagaaactgaagagattgcctggttcatcttgtagtcttccaaaacagcagataatttctgaatctcagatgttgaatcagtacaacgggatggatttcttgttcctaagtgttaaatgatcacatacataaaagagtctgagcctgagcaacatagtagagaccctgtctctac

SEQ ID NO: 600 - DNA, 2071 bp, Homo sapiens
attcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacggcggcaaggtggagctgagagttcttccagatgtcctccaggtgtctgctgcccccccagggccccgaggccgccaggccccaacctcacccccacgcatgacggtgcatgaggggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacacgtgcgggaggaaggtgtggtgctggaagctgtggcatggctagcaggaggcacagtgtaccgcggggagactgcctccctgctgtgcaacatctctgtacggggtggccccccaggactgcggctggccgccagctggtgggtggagcgaccagaggatggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactccccaggtcttgcaggtgtcaactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttat

SEQ ID NO: 601 - DNA, 2710 bp, Homo sapiens
attccgcggcgtcggctgcggctgcagtggtggtggcgggtaccgcacggggtatggtccccgggtccgagggcccggcccgcgccgggagcgtggtggccgacgtggtgtttgtgattgagggtacggtcaacctgggaccctacttcgaggggctccgcaagcactacctgctcccggccatcgagtattttaatggtggtcctcctgctgagacagacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcccctgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtaaggggacccgggggagggcaggggtctggactgagtgtcccagcagctcctgggctagagcaccaagaccaagtgctcctgggaagtaaagacataggatccaagaatgagggttcccccatggcctttgcggagctctgagggctccgggaaagtacagcccatgggtccaaggacctagtgggttaagagcgtttcccatgatcctcctgtgtgtgctcctgggattgctgggaaatgtggtcttagggccagagaagtagttttggagaagggcccccaaaggctcgtgggaaacagcatatttgtaactagatggggccagaaggtgcttctgttgggtcccccaagggctgcctagaaaacttagtgcctctgggccctcctgggcccaagggcctactgggagatgcagtcccttccccactgcccctcaggtcagatgctgctgagcgggggtccccggggcccggtcccccagccgggcctgcagcccagcgtcatggaggacgacatcctcatggatctcatctgaatccccaacacccaataaagttcctttttaacacac

SEQ ID NO: 602 - DNA, 2313 bp, Homo sapiens
cctcatcgagacttcaggctccaacgcaggccatgacgctgagaagctgggccacttcctggagcacgcgctgggctccggcctggtgaccgatgggaccatggccaccgaccagaggaaagtcaagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggccctgttctgcttcagccaccagcaccgtctgctcctcctcagaatccttcctcccccgtggcccgcccgccgtgtccctcctcctccacggcccgcccaccgtgtccttccctcccccgtggcccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtcccccttctgtgaggtgtcccagccgcctgattgccggagtcccagggtgctcggtgctgtcgtggagcctgggacattcactgtctgggattgattccagggttggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcctctagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcatgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 603 - DNA, 2039 bp, Homo sapiens
acatgatacaaccacccttcacatgaagatgggctaaataatgtggcagcaacccatctgcataggaactgagacaccaggaagtgtgagggagcccagacgagagtgtggtagccaaggaaaggttcattgtaggaggtgagttttgatgaacctccccttataggcagtaatgaaattggaaggagtcagcagaagcattttagatggaattaatagcaaagatatctgagcagaagtgagcagttgcggttaaagtagggccaaaagaatgacgtagtagaattggatggaccatatggctgtgctgcaagagatgagatgggaaagctgcctcatctgcttctgttttggcatgtctcttcctccttggttgggtttctttttctcactcatgcttgtccttcaacactttaacataaagcaaggtactttttactttcctgtgaccgtttttcaaaagtactcccagtttctgaatttaaaagtttcatgccgtatgccacttatatgatgtataatggtttacatggctttatttagaaagtattcctaaagttacctttctctttctgcagtatatcattcttgtcatagtgaggagaagtgtcccccttgcactttcctaactcagaagtggtgcatgggcaagcatgaggtaagttttctctctcaagtgctcattgttccaggcagaggttcatgattttattacttaagaattgttagtctcatcgtctgtcaaagtaaatacactcagaagtagaagctttccattgcttaaaaattttttcttaagatataatttgcatacaacagaatttaccctttttattgtacagatccatgggttttagcaaaagcatacataccatcaaaccactaccacaatcaagatatagaacagttcagtcacccccaaatatccttcatgcccctgtatactcaatgtcccctacttccaacttctgaaaaccaatgttgtctgttccaatcattttactttaaaataccaaatttttttttaataacctccttattcctgcaagaatggcaataatcaaaaaataatagatgttggcgtggatgtggtgaaaagggaacacttttacactgctggtgggaatgtaaactagtacaaccactgtggaaaactgtggagattccttaaagaactaaaagtagatttaccgtttgatccagcagtcccactactgggcgtctacccagaagaaaagaagtcattatatgaaaaagatacctgcacacgcatgtttatagcagcacaattcacaattgcaaaaatgtggaaccagcccaactgcccatcagtcaacaagtggataaagaaattgtggtgtatctatacgtaccatggaatactactcagccaggaacgaaataatggcattcacagcaacctggatggatttggagaccattattctaagtgaagtaactcaggaatggaaaaccaaacatcgtatgttctcaattataagagggagctaagctatgaggacgcaaaggcatgagaatgatacaatggactttggggactctggggaaaggacgggaggcgggtgagggataaaaaactacacactgggtccgggcacggtggctcatgcctataatcccagcactttgggaggccaaggcaggtagattatgaggtcgggagttcgaaaccagcctggccaacaaggtgagaccccccccatctctactaaaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataag

SEQ ID NO: 604 - DNA, 2278 bp, Homo sapiens
agtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagagtcccttcagtgacttcgagcgtgcattgagagcccagtaacactggggggcaactgccacaaagacacagcctcagccaggcgcagtgactcatgcctgtaatcccagcaccttgggaggccaaggcttgtggatcacctgaggtcaggagtttgagaccagccggaccaacatggagaaaccccatctctactaaaaatacaaaaaaattagctaggcattgtggcgcatgcctgtaatcccggctactcgggaggctgagggaggagaagcacttgaacccaggaggcgcggttgcagtgagccgagatcgccccattgcactccagcctgggcaacaagagcgaaactccatctcaaaataataataataacaataatagtaagactcagcctccccgctctgggacactcagtctgatggggcaggctggtcagaagacatagagccatggtgtgtttggaactttcacagagggaagcctggggctcgggaagcccggaaaagacgccggcgcagcctgagggcttgtacaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcccacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 605 - DNA, 2035 bp, Homo sapiens
acacatagacgatgcacaaaaaaccaccctgtacgaaggccacaaagaacagctcagatgcacaaagattcacaccatacaggccaaattatagaatcccccaaccccaagacactgcaccctatgggctataccctcaggcagggccctgcttttctaggaattgactccaatgcagaatagtgagaaatcaacaaaaagcaaaataagacaattccagacactcctgaatttacttggatttaaagaggttaataaaaacaaactataaactctctagactgggctgacagtaaaagcacagaatacaaaacccaggggatggggctgggaggggctgtgaggggctggcacctcagctcagaaaaggtagcagcaatcccaaagcagcagaaggcaggggttaaatcaggataaaaacagacatcagtggaatcgaaaaccaatagttagttaatataaagccaaaagcagtttaaaaaaaaaaaagacaaaatatacaactcttgataaaacataaaggtacagtggtctatgaggaagagaaaaggtacctgaggatgcagaagtacctaccacatgggaaccgtttgtccacactcattccagagaaaaccgagtcctctcagttgcacacgtgtacgtatcagtgggaagtgcttgccattactccaaagcctagaaccttcacgtcatgaaggttctggaaggtttttcagattgcttaagatacgcagccattccatattcatctccaactacacaggggaacggagcagatagagctgcgactgggaagcgtcaccttcccgtccagagcgctttctttcagaccctgcctacctgcaggcagatggaccggagggttttctgcttcctttcaaccagataacttcctaagtggagatggcctgtaggtagcaaatgcaggattttgtttactttcatcatgtcatgtggtggtcagactgctcgctggtggcctcgctttagaaggttttcatcaagccccgccctttctctctcatagtcttaatgcgtctggaccactggggaaaatatttttcttttcaaaaagcagccccttcagtctgcgttcccagttcattttgcaggcgcattcgcccttcctagtttgcagcaattaaagataacggagtgtaaagtcattagacccagaattagagcagccagcagctggcccagtgtaaaaatgtcccaagtgtagcccctcccaccgcagagcctgtttctaacgtacctgccattcgtggaagtcgcctgggttttgtaaaggagaattttttggactcaagctgtcatcttcaagcacgccaacttcaggcagtgttttctactgcaaacctccacatcctggaatcaatcacactgacagggaaaggataaatgctcctttataagccaacatgtatccaaattaagcccccttacctttatccagaccctttcacaaacaagttctgagtttttagccaattgatcctctactttccttctttagtccctctcagggacgcctccatccccggctcccctaaaggtagaagatactcgagcatgctgccaggggagctggatggtgaaacacctgaagatctcatatcgcctctcaaaacactgtcggacttgctttctgctttatgatgtccgtagttgttctaatattaaatgctttgaatttctttattggtcaagttattttaacttgggcaaggcatacagtgataatcccctggcatgccacgattccagctcttccaccccccttgaaatcttacctcccaccgtggtggttttgtaaacccacagtcaattggatttgcccagaacctcccctacaggcgctcccagcccaggatccaggagacccgcaacatggtacagtaactcttcaccaaccgtcatcaataggttttcttagaaactacaactttaagcaaaatgaggtataatgaaactaataaagtgctgggattacaggtgtaagtcactgtacccagcccaaaagcagttt

SEQ ID NO: 606 - DNA, 2610 bp, Homo sapiens
agagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaaaagtagcacttgttaacggtaaatacaaagggaagacactttgggctagtacatttgttcatgatataccaaatggctctagtcaagtggtggataaaactactgatgtagaaaaaactggtgccactggttttggcttaacaatggcagtcaaggcagaaaaagatatgttatgtactggaagtcagagtctgaggaacctggtccccaccacacctggggaatccactgcccctgcacaagtcagcactctgcctcagtcacctgctgccctttcctcaagcaacagagctgcagtctggggggcccaagggcagaactgcacccaggttcctgtttcctctgccagcgagctcacaaggaagacaacaggctctgctcagtgtaagtcactgaaggacaaaggggcctctgtgtcttgagtctgcagcagagtggctatggctggtggtttttccttggatgttccccagttcttaaagggtagagagttagagggttttggttatggggtggtctggtgaggagattgactagtgaagacagggaagggccaaccagtagaaccacagggaataagctgccacatttattgacaataggaatatttcaactatgatttaagaaataagcatagctttcacaggactctgaggtccacatttttgttttatggaggggctgtctagatgctcatgggcaaaacataaatcataggaattttcttgaacatggcccccatttcagatattctttcccattgtgagaccaagtgctttgatttttggtttaaacattaagatcagcatacatgcatccttttttgtttcatagattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctgtaagttggtggctgtactctggctttcaagagtccaacattatcaaagggaagcattagtgctaggctcaggg

SEQ ID NO: 607 - DNA, 2494 bp, Homo sapiens
ccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgagctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagttctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagctttttt

SEQ ID NO: 608 - DNA, 3105 bp, Homo sapiens
aaaaataaggcatttgggatgccgatgttaaaaggagaaggtaatcagagaagaaaaaaggaagtcggtggagagttctgcgaagattttgaagatttctagcagagaagcagggggttctggagaagggaatagacttggccagatacccaggaagacttcctcaacagatgtcccatcatgctgagattcaacgcgacattttagagtcatgcaaccatgtgagaaaaaaagtcccagtaacctttgttggggctggagggcaggatcccgaggtcccggaggagctgctccacctcctccagccaggacagcgcgtgcctcaggacgtccagcaccaccttctggagccccgagacaggtgggctcacctggaggtgctgaagaaggtcgacctccttcttcaggtcatggctgcaacaggatattttcatgcaagcctgcaaagaggtgagatcatgaggagcccaggccctgtggccagaaatagcccctgacgtgaccttcgaggaacagcgttcttgactctgccacgaagcaggcagcgccacgtattggccgccttgggaggactcagtttttttcttttttaaaatttttatgttttgacaggtttttttttaatactctaatttggacttttgatggtcaaagcgaacccccttttaggtctatgaaaccccagagccaaagtaccatcaacagtttggctgcaatgagaagcaaatgtggctacttcttttttccattcgtcagaattcctgccaagatcaacacacaagctggtcggaaagcgtggtttcctgatttgaaagagtgctgacaagccagcatttgcacaaactccccaaacaggagctgctgatttccagagaaagcagaagccaccgcctgctctgataagccatgtcccagggtgggggccgcagggctgtggccaagtcctcccgtccctgctcctccagagtcaaaagcaacggtgtggaaaccgccttttgtggctgggccaaaacaagaaaatgcaaataaaaagcaggaatgtttctttggtttctctggaaataacataggggctatgaaaacaatttctttttggctggggatgcgggccgctcaaagtcagtaattgaagatgctcaggcatcttttttggacacgccaagttctcccgggaggcatttttttaggccctttgttttttcttctccaacaagtttctccaacaagaggaaaaagtggatagaaaagccaagcatttctgcccaacttgctccaaaaaagctgggcaatttcccaaataagccgcacaaaaattagacaaagagaccatttgtggaaagcgtaaggaggggccacctggcagctgtccagcgacgtcctcagcttctcgatgttctcggtggtctcctcctgcttggagttgctcagctgggtctctttctggagggtccactttttctgctgaaaattgatgttgtcctcagtgacctgggtaattttctctattaactggtgagaaaaagaaaaaggaaaaaaaaaaaaagatgtaacatacaggggtggggggccctgagggaaggggaatgggagaggggagagatgcaacttaagtccctgtctaagcacgggaggacagaggtcctgatatgtcttggtgatggctgtcaagggggacgttggtcctgtcaccagggaatgagtcccagaatcagagattctcttttcttttttcttttcttttttttttttttgcgacggagtttcactcttgttgcccaggctggagtgcaatggtttgatctcggctcaccgcaacctccgcctcctgggttcaagcgattctcctgcctcagcctctgaagtagctgagattacaggcacgcgccaccatgcccggctaattttgtatttttaatagagatggggttttaccatgttggtcaggctggtttcgaactcccgacctgaggtgatccacccgcctcggcctctcaaagtgctggcattacaggcatgagccaccactccttgccgatcagagattatttttatgatccaaaggcctgtcttgtggccctgagtttgttccagattcttctgtgttgtatagggattcagaacactgagcctgatattatgggctcataagcagcaggtcaggttctcccacacccactgagagcagcccacggcacattttcccatctgtgctttgacacagggggctagaaagtgtagtggaagaacagcaaggcaatcattacagccagacatccaccctcactgccactgtcaacttttctcctctgaaggaacgcgccagaacgcactggctgtggggaggcggctccctttctcccagtgctaatggaggcgaaacatgcatgtctggagaccagaagtaagcccgaatggtttaatttgattttcacagacacatttcaagggagttttaactggcttttactttaaaagccaggaaatcccataaaatcaaaacaaatctttatggtgtagcaacagtgtgaaaaatatgccaccaacaaaaacagaaacatatgctcccagggtctggaatccagatccacgaagaagaagaagaggaaagtgaaggagccacgtggcagggacggcagactaacctgttggtcggtgtcgggcttgtcccggaacggcttcgcccgtccataggtggccttgatgacttgacttctgaagtgctccagctgcagcagagagggggcaacagtgtcagggggtcagcaggggccggcaagtgggggcagcgtttccatggcagggtgcgggaaacaccacttagcagggtttgcacgcctgaatgaccattccgcgttatcagaatcttcaccgctcacggggagtggcgggacccacagaagaaaagagaacagcaggctttaattactttttaggcacgcctgcctaacccgaacgatgcctgtggtcagtgcacacacatgtctcaaaccctcagaagagcctcttgctgccaattatccaatgggaagtctggggccgggagcgctcttccgtaattgctaagttggcaccagactgtgaaataaatattgaggctgtcagtcc

SEQ ID NO: 609 - DNA, 2860 bp, Homo sapiens
ataaaaaccaccccgtttcagccctcagcctcagggctgagattcaggctcgggtctaggggttggggaatattaaagtttacaagtacaatcttactccatccatacacacacatggagaagccaggagaggacgcggccagagatgggctcctgcccttgaacccctgctggggtggaagcagagatgggggctccctatgttgcccaggctggtctcaaactcctggacccaagccatcctcccaaagtgctgggattacaagtgtgagccaccacgccaagcctgactttaagatttttgccaatccagtggacaagacaggagactggaagaaggggccagaaattcagactcagaagccccctccagaggccacaaggcagcctggtcctctctgaaccagtggctcccactcactggccccttgtctctgcctggactcctgcggatgagtggaaggccaagagggcgccctctggtgcccactagatcgactcccaattaatcacttaactgtgtgaccctgggccaactactcaacctctctgtgcctcgggtcctcctctgaacatggggataaagacagtgcttgcctcgtggggatgttgtgtgtgtatacatgcatacacacgtgtgcaaagagcttagagccacgcctggtaccatttacatgctcagtaaatgtttaggaggattgttgtgataacccagcagactgatgtgtaagcctatggtcccatctcagggcatgtgggtgtcacaggatcgtagtcctaacagcccaaaaataatgttaaaatgactcaaggacttcacttatgcttctgagcatcctgaaggaaataggcacagtctacagaactacttcctaatgctccccttagttcaactgtccacttcctcagcacagtccctgtatgtctttggaggtcccccttctccagacctccttcattcagccaacagcgtttattgagcacctgctctgtgccagccagctgctgttctaggctcttagaataaatcagaaaaccaaatagatgaaaaattctcattgttcacaagtagattctagacgtctccccagagcaaagcccaggcccttggccttcctctcccctgcctctttcttcctcattctgcacccagaacccaagaaaacgctgcagcccttcctgggagggcaggagagaggaaagatctgagttggccaagccaggctctccagcaggcagggctccagcagaggctgggcaccttcagccatcagcaactgtgtcccattacctgtggaaagcaccagccctggcctggaaaacagtaggagttcatcaagagtggctttgttgtacagtggttgtcttgtacccagttggattggcagcagcttcggggcacgaggagcgactgttcactccttggggagcttgcagcacagggcaaggtgcacagtaggcacttggtggctggcagggccctctggggcatcctatgggtgaatatcttgctgagcccatggaaggcccatgtcagaatccagtaatgtgctggggaggcgagctggggtggggttggaagtggtgctcaccagcccagccagggttcctcttaaaagtcacagtgctcgaagccagtacagtgcctcacccctttttatgccctcacctggctcatctcccatccattagtcctcaaggtacatctgtgagtcccatgggtcaggtagtgggtgcaatgggaggagatgagggtgtggacttgtcctcagatctacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttgcctcaggaagaaagcctccaccttcagactatcaggcacctggggacagaccccaggacactgccttttgtggctcttgccacccatggtcacctcagttactcaagccacacatgcatgttcgtgcatcccccacatatacacagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcacttagcattgtgccttgcacagagtaactgctcaggaaaggttatccaataataatgaaagcatgtcttatggtgtgacacctctgctcaaaatcctttcatagatccaattgtctaccatggaaacccggcctctgggctgtggatacttgtgatgggagaggtggtgcgggctccgaattctttccaatagtctgcaaacccgcagagccatgaagcattgtctgtaggccagcactcatcctccacccctctgcctgcttctccgctctcctagttccttctccctcctctaggaattcagcattgccactctgattggctggattttgggacattgattgagccttgttttctagtgggcaggaggctctgtgtcttaaaggccactggcccagctgccaatgaatcagtactttgtttccccaggtagagtgggggcagggggcagggaacgggcagggcaagtttggggcattctgctccgaggtccctctagccaaacgttatcaaatctcatccaacatgctcctggctctccatttcagatgtctgtaaactggggactacaaaatgcaaatatgtttaagagttgct

SEQ ID NO: 610 - DNA, 2549 bp, Homo sapiens
atatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggtaacgcgttgggttctttccattgccgaccgcattttactatcttcaaagtagcaggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcaccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgggatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctccatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtg

SEQ ID NO: 611 - DNA, 3333 bp, Homo sapiens
acaaaagagctaggttcccaggccgtgctgaagctccatgagacctttcctcgtctgtgcacagactggcagccgactctggaacccagattgttgcttcccggtctagtgatccttcctccatagtctgatactcccacacgggaggtactggaacaactaggtcagctacaggacttgggggatcggatgccctgtggggaggagaggattaaggagtggggcagacaaacccgggaccaatctcagactaatcagaaggctgaccaacaagctaaaatttccactattactgcagactcaggcccagaagaaccggattgggctgcgctcatgcaatgggtgcatctccagtgaggacatctaggcatccagggaaccatggcttggggacagcaaagagggatatcattaccgaaggatgtggttcacacaactttatcccaacgcactacacgccaacagttaaaaactaagccagttcctcagagggttttggggcacattcataggggaaaaatgccaggacaaatttggcaaatggactatacttgtcctttgccacttctaaagggtgccaatacatatgtacttctgtagacacctgctcagggttcctagtagcctgcgcttatgctaatgctaaccaaactaacactattaaaaccttaaacatcctaattctatattatggtgtgcccatacaaattcaaatggacagtggctcccatttcaaaggtaaggctgtacaaacctttgcagcccaacatggcatagaatggattttccacatcccatgccacccacaggcagctggcctaatcgaaagaatgaacgggttattgaaaaaacagctaaaggtgttagggcaaggtaagttaaaaaaatggaacgatcacctgtttgagatagtacaaattttaaataatcggccattaacaacatctgaaaccccactgagccaaatgcttatcctacacttacaaattgctaagtgtgcaggtgtagtccaccctctcttgctgaaatgctggaaaatccacccactcccatggaggagtacaagaggagctgccagtttggacttatatagtttaaagcctgggataattcccgcccaaagtacatacacggtagccaccggcttaggagttattataggtattataccttgcaaacattatgggtggattacattccaatcaggtcttgcaatgcggggtattacagtacacgggggtataactgacagtgattaccggggagagttaaaggtcattttatacaataccactccagattcttttgctataaaactgcagataccagttgctcaattgttagtggtaccttgtcagcaattaaccctgtaggaaatctctgccccaacagaggctacatacagaaccaggttattcagatccactggtactagtggcttaaatcctggagccaaaatataggtacagcgtccatcagatcccacccctcaggctggtgaccttgtagctatgggagcagaaaatgaaggcatagtacaatttcctaaatatgaaaaaacaatatcatgttcccctccacttttgctattacagggaatgacctatctactgatgtgtcttgtgtctttgtgtctgaggcctagaatgaatttattacctggtagccactgctgcaaaagagctcaaccgcagtcagtgctggtatgtgtcgagttgccagaggctgcagggaatggattaccttagaatattatctctgctaatatttccaagtggctatgtcgctaccaatggggttgggagaatagcacctgtagtacaacctgaacttcttttaaccaaactaaacagtctattcttgcccaaattcaacaaaaggcgaaatccacccttgcaatgagtcaaaagcttttgtatcctacctgatatgcctggaacagcgtatacggggaacctgtcatactggtagctggactccttatggccccccctttgtttgggggccttaaatggcttccccaatgacactctggggtttctcccaccagacagttgtcagcacatattccaaatcaataacagtgcccccagtgaaacacagcacctttgttacttaaattacacattacagcaatacgattgtagtagaactcttccccttccctggggggccctctgtgtatgcggatcctatgggtggtgatacttgcccccgaactgaacagggagatgcacttgggggtggccattaattccattcactatctgggataatatttccctccccagtaatctagttacttacaaatattgctggttacaaatgcgccagactccctggtggtggtaccatatcactgctggtacaatcctgcttcaacaacaaattaaaatactaagcttgcatgtagaaaaagctcttaatgctagtagcactggacttacgttgttatcagatgaatttgctcaggggcgtactgttgtgttgcaaaatcaaatggcattacacatccttacagcagcccaaggaagggtttgcgccttactgcatgctgaatgttgtgtgtatatccctgacaattctcacaatattactctccttgcccaagacatgcaaaaacaaagcagttagaatataaccatgggcaccccatcgtgaattggctgtccgactggcattggcgttggccgtggtgggtgtggtttttattaattgtgcttttaattctcctgtgtttaccctgtatctgtaatctatatcaactatgccttccccatgtatctttacacgttttatccacaactgagtatcaaattgaggccgaatgtggaggaaaagttaaatatttaatttgaactcaattgaacatggacataaacaatggtcaccaactcccggaacaggttgcatgagccccttgaggcattcatccagcaaagctttttagagaaatctgctcctgtacgtcagttactgagaaacaacagacaatcacaaaaacaagtagacctttttgtgtcccttgagcccagtctcgaagggccctcgtgactgggcctcatgccaaacaattcattacaaaagagctagggtcccagaccgcactgaagctccatgagacctctcctcgtctgtgcacggaccggcggcccactctggagcccaggctgttgcttcccagtctggtgatgcttcctccataatctggtggtgtaaatatatatggacatatcttttcccttcactcctttccactgcaatttgcttgttatatcatttgcttattatatctatattgccatatacgtgggataaaggttgttcaccctt

SEQ ID NO: 612 - DNA, 2326 bp, Homo sapiens
ctaccgggggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgcaagctgaggacaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggaggtggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttctgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaagtttctattaaggcagtgtttcctaaatgtatttgacctcagtatcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaac

SEQ ID NO: 613 - DNA, 2897 bp, Homo sapiens
tttgaaatgcagaacacactattatttactatgttcactatgctgtgcaatagatctcaaaataaaacttattcctcctgtctgagatttttgtatcctttgaccaccatctcttcattcctcccactcccccagcctctataaccacgctcatctaatttttgtatttttagtagagacgggttttcaccatgttggccaggatgatcttcgatctcctgacctcgtgatccatccgcctcagcctcccaaagtgctgggattacaggcatgagccactgcacctggcccccttcatggtttctgatgcaaaattggtaggcatttgaattcttgtctacttatataatgtgtcatttttctctggatgctttcaagggcttttctgtctttggtttttagtagtttggttatgatgtgtctgggtgtggcattcttcgagtttaatcaactctcatgttaactgagtttttgaatctataaatttttatatttggctaaatttgggaagttattagctactattttttcatacctttttgtgcatcaatctctttctttctccttccagaagtccagtgaaataaatgttagaccttttgatactgtcctatatttcagattgatatttaagattgttctttaagtctctattcttttttttttaacatgtttttcctctctgttgttcaaattggataatttctgttaatctttcagctcactgaatcttccctttggtatctccattctgctattgacctcatctagtggatttttaatttcagatcttatattttttagttctatagtttccatttttttttttaatggttactttttctctgctgagaacttccatcttcccagtcatttctctttactttcacttatggaacatagatgtaataactgttttaaatctgattctggtaattccagcatctgtgtcatctcagggttgacatctgttcatcatcgtttgtttctcttgagaactggtaacattcttctagttctttgtatgtcatataatcttggagtgcatcgtcagtgtattttgaagagtatgtttaagagtctgggtcctgttaacatctggagaataatgattttgctttgttttaacaggcaatccagtttcacaagctctgcctctccttctgtgggtgatgggttcaatgccagttttattttaaaagcgtttgctatcctgtttgagtttgccctcatgtgcgcctctcagtgatttgtctgcaatttgaatgatggtttatatcatagtttatttctgagagactttgctgtgcctttggggtctattccatgcatgtgccacttgggtgagtctggggcttgtgttagttcctacacagaattaagggattcccttctctggtcctttccttgctgggattttcttccccatctctggctcccaggcacccctttcgctgtttctcttgctagaaagatgggtttctctcagacagttttaacctccttctctgtcacacagttccatgtgactggcttcacccgaagagtgaggcagtgaaagaaaagagaagaaacaacaggattccttttacatgcttacagccacagagaccccttctctcatttcttccagggaaagagacaggctttgaggtgcctggactgctggccaacctttaggcaaggccaagagggaaaaaataatgaatgtgaaagtacgctgtcatcatgctctccagcccacatggatctcttgtcctcatcctctggccagaaagaagttttatgggttttgttttgttgttgttgttgttgttgttttgctgtctgacccctcacacaccttaccccttgggcatttctgcaaagaagaggggaaaagaacccaagaaactccagtgtactacttgatcttccagtttttactcctctcctctatcaaccagctatttttccttttcagaatcctcaattgctttttgtgttgtccaatttttaattgtaacctgtcaggaagagcagcttgtagtgggcatattccattttatccagcactggaattggcattcagattttttttgttttattttgttttgtttttgagatagtatctcattcttttaggctggagtgcagtagcacaaacacagctcactgcagccttgacctctgggctcaagtgatcctcccacctcagcctccctagtagctgggactacaggtgtgtgccactacatccagctaattttttttggtggtggtttgtttgtttgtttcggtagagtcagggttttgccatgttgcccgggctggtctcagactcctgggttcaagcaatccctccaacctcagcctcccaaagtgctggcattacaggcgtgaggcagtgtgcctggctgacactcagatttttaatgccttggtcttacaaatgaatagacggttaatggtcctcaaacatttgagaaaagtctctagtatgagagacagacacatatggatgtatgtccaaggaactcagagcaaccaaaaattgaagtagccagaaataaacttaaaataaacataaattatttgatctccttagatctaagaaaaagtgatatccttggctgggtgcagtggctcgtgtctgtaatcccagcacattgggaggctgaggtgagtggaccatttgaggtcaggagttcgagaccatccttgccaacatggtgaaaccccgtctctactgaaaatataaaaattagccaggtgtggtggtgggtgctggtagtcccagctacttgggaggctgaggcaggagaattgcttgaacccaggaggcggaggttacagtgagcagagatcaagccgctgtgcgaccgagcgagactccgtctcaaaaaaaaccatctcag

SEQ ID NO: 614 - DNA, 3127 bp, Homo sapiens
agtgctggcctctgcctccatctcagtcacacatgtctagcctccaggcgctgtgctctggcctgcccctgcggcccctcccagagaaccggggacgccaggctggggtgccccatgcccctgtcaggacccccagcctcagccctgtggagaaacagctggcgctgaggaacgccctgcgctacttccccccggatgtccaggagctgctggccccagagtttgcccaggagctgcaactgtacggacacatctacatgtaccggttttgccccgacattgaaatgagggcctacccgattgagcagtacccctgccagacgaaagtggctgccgccatcatgcacatgattatgaacaacctggatcctgccgtggcccagtttccccaggagctggtgacctatggaggaaatgggcaggtgttcagcaactgggctcagttctggctgaccatgttctacttgtcgaagatgacagaggagcagactttggtcatgtacagtgggcacccacttggcctctttcccagcagccgcagtgccccacggctcgtcatcaccaatgggatggtcattcccaactactcctcccggacggagtatgagaagctctttgccttgggggttacaatgtacggccagatgacagcaggtagctactgctacatcggtccccagggaatcgttcatggcactgtgctcaccgtgttgaatgctgcacgtcggtacctgggcatcgaggacttggctgggaaggtctttgtcacctctgggctcggcggaatgagtggggctcaggccaaggccgcagtcatcgtggggtgcatcggtgtgatagcagaggtggataaagcagcccttgagaaacgccacaggcagggctggctgatggaagtgactgacagcttggaccgctgcatccagaggctcagggaagcaaggaaaaaaaaggaggtgctcagccttggttaccatggcaacgtggtggctctttgggagcgcctggtccacgaattggacacgacgggggagtgcttggtggacctggggtcagatcagacatcctgccacaacccgttcaatggcggctactaccctgtgcagctcagcttcacggaggcccagagcctcatggcctccaaccctgctgtgttcaaggacctggtccaggaaagcctgaggaggcaagtctcagccatcaacaggttggccgaggagaagttcttcttctgggactacggcaatgccttcctcttggaggcccagagagcaggagcggatgtggagaagaaaggtgctggcaggacagagttccgctacccttcctatgtgcagcacatcatgggggacatattctcccagggatttgggcctttccgctgggtgtgcacatcgggggacccccaggacctggcggtcacagacgaactggccacatctgtgctggaggaagccattgctgatggagtgaaggtgtctgtgaagctgcagtacatggacaacatccgctggatccgggaggccgccaggcaccggctggtggtgggctcccaggcaaggatcttgtactcagaccagaagggccgcgtggccatcgctgtggccattaaccaggccatcgcctgcaggaggatcaaggcgccggtggtcctgagccgagatcaccatgacgtgagcggcaccgacagcccctttagggagacctccaacatttacgacggctctgccttctgtgcagacatggctgtgcagaacttcgtgggagatgcctgtcgcggagccacctgggtcgcccttcacaacggagggggcgtgggctggggtgaggtgatcaacgggggattcggcctcgtgctggacggtaccccggaggccgaggggagagccaggctgatgctcagctgggatgtctccaatggtgtggcccggcgctgctggtcagggaaccagaaggcctatgagatcatctgccagaccatgcaggagaacagcaccttggtggtgacactgcctcacaaggtggaggacgagcgggtgctccagcaggccctgcagctctgagggagccaggagtcgcggcccctgcctcccttcctccctggcgatcctcacctgcccagccatggcacacacccttcctgcacacccgcactacctgcacttctcgcacatcctcacgtggcccttatggtgccctgtgcagggtgccaccacagcctcattttacagacagccccctgaggcccagagacatgcagctctctgtccacaaccatgccacttgcatgggagccctgaaggctgtcaaagtccatttagggccaagtcccaagcctgcccgggggccctgcggtgaacactggtcaagctctctccggctgggatgatcacaccctctgcttcctggccacctgccagcctccatgcaactctgtctgtctgctgcccatctgctgtctgtgcaagcaacttctggaccctggcaccctgggctgctggcctggaggagttcgggaaggaggatagaccaggaaataaagggtcaacagagctgtgtgctgcactgtgggctggtgggacgggcaggccgggtctgccctaaggataaatgatcacttactggggaagaaatgagagagcaggggcacccccctaggccagcacagcctgaggggtacagcaaaggggaccctttgctggcccctgaggctggagtctggcaccccttccccaatcccatagcccggtaatgactgggtccagagcctcgtgagaggtcaccgggatgggggaagtggcctctgtcagggccagggctcatgaatctcattctcttagctgggcgtgcaacagaccaacagataactcatcctaaacagagaaatgagaaagagtctgtgggtgggcctctgagggccacagaaaaccagacaccccacatgtctgtggattggagaggggcaggccactgccctctccaggaccaagccgggttcttggtccccaccctccctgcactccgcatctcctccccagcagccattctcccctttcccttgtgaacaaaagcctagttttgtgtgggcagcaatatagggtaaataaaaccacctgattctccagcc

SEQ ID NO: 615 - DNA, 3578 bp, Homo sapiens
ctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggtaataagtatgaaatcttttggtattgctacatttgaattacagatgtttttcagtaaatagaatatgtacagctatttagactgtgaagaataatctgttggtggcacttatcatacatgatatagccagtatacagaaggtctgcctatttacaaatggttatagctctctctgaatggccaggtggatcctgccaaatctgggaagtcatttgttactaacatctttcctagatgattggttggctggctggacaaatggaaggatcagtaaaataccttaagtattgttttcaaagatgcagacctggattactagaggagccagcagagtagtgcagaagttgagtttttatacctttttttttttgtaaagaattgccacatattatataattggaaattatacattttataagaataagtagctgttattctcttatgtttgcctctgctttttctagaccatgaagctgtttattacagggtttatattttgaattcttagcatcatttcttttaaaatattgcaactttgagtctgattttgagataaattgttttatttttggagtttcagtcttgcacttgtgtcctgacttaaatttgttgcttataaaaatggtttgtctattaaaatgtcaaacacagatccagagatagaagaataaaatataatcatactcaacttcccccttcccttctgaaaatgggtagaaggtggtagttttccatctcagctattaatcgctgtttgacatagggccctgccacttaaggcccaaggacaaatcacttatcctctgagagctgaatttcctcatctagaaaaactgtacttaacttgcaggattattaggaggagtaaatgatgtaggcaaagtgcctagcctggtaagggcttaataaatgatagctattactagcttgaaatttttggaaagagttagctttgcagataactacgtaaacatgaaaaaatatttatttacaatcctgcaagaaaatgtgtgtccccatattccatagatagtgccatcagtacttgacttgaagaagccagtagagtattaactgcagtagatccatattttaacagcacctttaaaactgtaaagcactatacataaattgtcattgtaaagattgaatctaatgatgtgagtaaatgcttggcacagtttgtggtgtgtagtaaggagtctataaaagtaagctgccattatttttgtttgttaatattattgttcatgctgccagcgctaccactgcttctacatatttgacatgttggcatttaaaacagatgagctatttgaatttctgaataatgagattttgttccctcaaacttacttaaaagttgaaaatttgcttcatttttccctttatatgtttatttgtggcaatttcttaatgtcatttaaatgccactcattaaaatacaagaaataagtcattttatctttaagtttaagaaaaaagtgctggatggatagaaaaattattctaaaatattctttgtcgtactgtataatttttatctactggatatctctgttcaatcacttaaaatttgctgtgttatattctgctttcgtaatgtatttttaagcaaaaataaagattttttttattgcatccccaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagt

SEQ ID NO: 616 - DNA, 2566 bp, Homo sapiens
attcgcggcagccctctgcggtcacccgcaggcgcccatgactccgatgaagccacgccaaacaccacccaaccacgtggcctcggcacccgcctcctgtctctgcctgtgaacaccgccagccaagccgaggccagggctctcggaacacgctggctctgaggcccatcctattcggggttgttctctgctcagttaaactctgttcaatacagcgtgtctaaggtttttcccttttgacaggctccaggactgaagccgcagaggccactcccacaggtcaccagaaactaagacgtgagtgacgcccggcagtggccgactcttccgccgtggctgtgcccatgggagacgtgagtgacgcccggcagtggccgactcttctgcggtggctgcgcccacgggagacgtgagtgaccccggcagtggccgacttccacggtggctgcgcccacgggagacgtgagtgatgcccggcagtggccaactcttctgcggtggctgtgcccacgggagacgtgagtgacgcccggcagtggcttactctttcgtggtagctgcgcccacgacttctggagacatcagaggcttccaggccccactgttttctgcatttggccactgcccacgcttctggggctgaggtctccctcttggggcccttttcagcccctaaagatctcctagcctccgaacctgaaatggctcccccaaattgcagaggaggtggggaagtggcagccacagctcagtcaccagcctgctctgccgcctgtgaagctgcagctggcaccaacaccccaaccaaaatagtggctgagacgtgcccgacagctggcgtttatttctgtattagcagaatcgggtgggagtcagcacctgcctgacccggctgcagcatgccagacgccgtcacctgctgcctgggccctggaaccctccgcaagataccagccaggcctcacggcagcccttgctgggccctgcattaactcccccaggccttggactctgagagttgggactctcgtctggcccaggtgacagaggaggaaactgagaagcagagagccacgtgactcacctgtgggtggactgtgggaatcgccaagctcggatgagaaccacgtgggcagttccaggcccgaggccgcccaccccggggggagaggctccccggagcatctgagtctgcagcccactggggtgtccgcccgtgcagccaccaagcctgctggccctagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgtgggacttgagcccagatcctggactcccagggtggggctttcccaccgcacccagctccctcccatggcgtggtctggagaaggcgagaggacgaaggggcagcagatcatggttggtcttcccgcctgcacccgccctgcccagcgggcaccacatgacccaacacagctggggaaatgcaggctcagagagggggaggcagccctgggcctacaggcggctcacacgagggagctgggagtgaaacccagctgggattgcctgcagtgtgtctgctccagccctgatgggaagccctgaggttcagcttccccttcccttcccgctggtttccagccttggccttgatggagcgtggacctaggacgtggacacccacgttctgtggctgctcaagtgatcctccagccttggtgaggacggcctcaagacccacgtgtgcgggtaaagactccgcagcatgcggccgaaggacggcccggtgtacgggatccgtatgcagaccctgcctttgacgcctgtgtgtacccgcggcgcccgccgcctcgtccttggctccaggctggcactgctgggccgcaagccgggctcctcgggtgccttccccaaagtcttcccagagctgccgcgggagggcggacaggcgtgctggaccctgagcatgctggaccagggcccagcagcaggccacttgggagagccagcggttctaagcatttgtaaataaatccaattccccaacttt

SEQ ID NO: 617 - DNA, 2748 bp, Homo sapiens
gagttactgtgctctcttccaaggctataggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgacccccaagcccagccctgtggtgggtgaacgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttccctgagaattaagctactggtgtctgagaaaagctgtgatgggtggctgaacttcaagaaactactaaatgaggcatccaccactcatcactgtgtggagactggaagccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctctccagttacaagttcccccatctacagaactgcgtcactgtaggggagtcccttcttccagaaactctggagaactggagggcccagacaggactggacatccgagaatcctatggccagacagaaacgggattgacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatggagcaccctgctgtggttgagacggctgtgatcagcagcccagaccccgtccgaggagaggtggtgaaggcatttgtggtcctggcctcgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgattatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagcagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaacc

SEQ ID NO: 618 - DNA, 2360 bp, Homo sapiens
attttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagtcacgctctgtcgccaggctgaagtcagtggcaccatctcggctcactacaacctctgcctcccaggttcaagcaattcttctgcctcagcctcccgagtagctgggactacaggctcgtgccaccacaccagctaattttttgtatttttaatagagccaaggggcttcaccatgttagccatggtggtctcgatctcctgacctcatgatctgcctgcctcggcctcgtaaagtggtgggattacaggcatgagccacgtgcccagccttcatgtgtattttagacaatgaaaatgatgttagacaaaaaagcaaatttgagcagttttcctttttgagttaaaaatgggttgtaaaacaacagagacaccatatcagcaatgcatatggttcaggaactgttaacttacagtgcagtggtgattcaagaagtttttttgttgttgttgtttgagatggaatcttgctctttcaggctagagtgcagtggcatgatcttggctcactgcaacctctgcctcctgggttcaagccattctgcctcagcctccccagtagctgggattacaggcacgcaccaccatgctcagctaatttttgtatttttagtagagacggagtttcaccatcttggcccaggctggtctcgaactcctgacctcgtgatccgcccgccttggcctcccaaagtgctgggattacaggcttgagccgctgtgcctggcagtttcaagaaattttgcaaagggaaggaaagtcttgaaaatcaggagcgtagtggctggtcgccagaagttgataactaccggttaagagcaatcagcaaagctgatcctcttaaggctacttgagatgttgccgaagaactcaatgtggaccattctacagtccttcagcatttgaagcaaattaaaaagtgaaaaagctcgataagtgggtgcctcatgaactgaccgaaaaaaaaagtcattgttttgaagtgtccttatcccttattttttgcaacaacaaaccatttcttggtcagattgtgatgtgcgagaaaaagtggattttatacaacaactggtgatggccagctcagtagatggactgagaagattctccaaagcacttaccaaagccaaacttgcaccaaaaaaaggtcatggtcactgttttgtggtctgctgctggtctgatccactatagcattctgaatcctggcgaaaccattacatctgagaagtatggtcagcaaatcgatgagatgcaccaaaaactgcaacgcttgcagtcagcattggtcaacagaaagaggcccaattcttcacaatgcccttccgcatgttgcacaaccaatgcttcaaaagttgaacaaattgggctgtgacattttgcctcatccgccatattcacttgacctctctccattgactacgacttcttcaagcattgcgacacctttttgcagggaaaacacttccacaactagcaggatgcagaaaatgctttccaagagttcgtcgaatcctaaagcatggatttctacactacaggaataaacaacttaaaaatgtgttgattgtaatggtttctattttgattaataaagatgtgtttgagcctagttataatgatataaaattcatggtctgaaaccgcagttatttttgcatgaacgtaaatgatgaattttagatgctgaaatttctgggcatctaaatcttctttcacatccctgattatttttggaataaactcccagaagtggaaatataaggctgaaggcctggtgtggtggctgaagcctgtaatcccagcactttgggagaccgaggtgagcagatggcttgagcccaggagtttgggacaacatggtgaaacctcatctctacaaacagtgcaagaaatcagccagcgtggtggcgtgcacctgtgttccccgctaatcaagaggctgaggtgggatgatcacctgagtccaggagatcaaggctccagtgaaccatgattgtgccactgaactccagcctgggtgacagacttcatctcaaatatatagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaagt

SEQ ID NO: 619 - DNA, 3130 bp, Homo sapiens
ttacagatgaggacatgggcccagagaggttatgtgagtgacacagcttgaaggtggagttaagcctgggcagtctggcttcagagtgtccacagtctcaaccactgcctcacatggcttcttagaaaatattataaaaagaagctcgggctgccatgtggaaaagaatggagaggggacaatgacacagctgggagcatgctgtgatggtgtacagtggacacattcaggatgaggtgaaacaggctggccctggtgagaggctagatggggctgggatgagggtggagacaagtagtcttggggttggcttggtgcagctggggggtgcggggagtgtctctgaggtgaggccgggggtatgggaacgccatgtttggtctgggacacggtgggcttgggatggctacaggacagtgcagtggagagtcaaaaaggctgctcggacccaggtctggcgagatggaagctggaggtcaggtgagctgtctaggagagggacagagtgggaaggagagggtctcgactcggctttcttgccaaaggagggttccgaaatgagaaactgtggaatctaagctggagaggaagaaagacggagaatgagtgaacgcacacgtgtgggacagatagatgaatattcatgtctttggctcctatgtacctgagtcttctaaagctgcaggccatactacccccgggaggctgcagggatgccagctgggagatgaatgcaactctgctgcctgggcatgggcctgagtgagggtgcagacccctgcctgtgatcatcagggagggtgatgagaacaaggtggctgacagggtgaggcccaagcctggagcttacccaggtgcggggatgggagggtcagagacctttggggggtcttagggagcttccccagccctaaaggcaccgcaagctgccacttcacactgacctgggcatacgcagctgcaggatcccttgctcgctctctcacaagcaaatgtagactgtgcaaccatcctgaccacagatccagaaagcccaggacataacagggccgcagtgcctgccctgatccacgcgcacacagatctagcccaggaacaagcccatccacggtgaggaacttgtggcccagtggctggagcctctcacctgagccctcactgcctgaggacccccagcctctggcctcatttcccaccctttgccagccagccttggggacaaaacaggtctggatctaatccaaggtctggactcaccctgacaccctgtgaactcaaggccttccctacctcaccctgggcccagagcccctacctgtaaagtggaagtgggaatggccaccagccaggcagaaaccctcacttagggcctcatggccaggcatcaggacagtcaggagaggggccgaggtaagccacagaggccctgcctgtcttggtatcccaccatcgccaggaggggactgcatgggcatcacacccctcacagatgaacaaagtgaggcagagaagggcctcaagatgagttgggggcgaggccccagctctgctgctgccccttcccttatcacccctgcagcctgggatgcgagggtggccagtgacagaccccaaggactctaggctaaggtctccttacctgcgttctgtggcctgctccccgcctgcatgccgcctcatgggggtcctctggctggcccaggagcacggttggcccagcagagcagctcagtgttatggggaagggaggcccagcccaccacgccgaccgcctggggccctatgtatatttaatgatgtctattattcctgttttgtctctggaaaggagtgagcagctgacaggggagccacgaacagcctggagagctgagcatgggcctgctccacactccagcggggcccgaggcccccgggaactctacccctcctggcagcctcacagaacctgctgcatccatctcaaaaggcatacctcctccaggaagccttccccgctgctcagaggtcttaaatccggggtctgcgctcacaaactgtgcagcctacaccagcttctgggggacagcagaacactgtggggggcctggcacagtccctggcacacggtaggcactcatcgagcccctgccagcccctctactcctgacttctgaggcaacaggaaatgacccgccaccttgttctcacagagcctccctgccagcccagatggtcacaagggcctcctgggatgctgcccaccttggcagccaggcccctccggaggggccagtctgggcctgacacccccgaacaccaaccccctgggcagagcctgcctgtgcctgggtgaggaaccctgcagtctccttgccacacaaggcctgggtctgccttggggcccaggctgcaccctctccgacccccaggcccaatgcctgacctgtgcccacctgactcaacctggctactgttcagcaagtttacaaagtgttctcagtctgaacaggaaccgttttcaatcctttatttcagaaaggagagccaggagaactggggacttagaaaatacagatcctaaactcaaaagtccctgccccaggcgtgcagagccagggtcctggggttttgtgctgggcaggggctgccctgggagggggaatacagggggaggcactttaggacaccccttaggctgtggagggtgtcagctgggcctttgaagccactaaccactggttcccatcatggagagccctgtgtggggcacccaagggggtttcctcctggaagggcccccaacccaagtgtcagagaagctggcaagagctgagggagtgaggtgccatgacagcagccacagcctccagggacccaaacaggcccagctaccagcctggcactgagcatgccatctgctttaggccctggctggcgggcatgtgggcaacttgctccctcagtgcagggggctgggaggcacagatgcaggctcagcactacaaactcaaaacccccatgagagggctcagtcttatgggaaatgcctccaaccgagcccctttgccccaacacactcttcgtctgcctactgaagaaacttctgtaaatagcagagacttgagggaccccttcctggggtacgtgt

SEQ ID NO: 620 - DNA, 2703 bp, Homo sapiens
catttctttcccatcagtaaacacatttcgcctcttcggccgaggtaggaatataaaaggcccctggcctacccaagttttggtccagcaggggagccaggccgggaaagggccaagccgccacactcggcttgtggggctgtgtggtgccgtgatgcagctgtgggtttggccaccgacagacctgggctcaaattggacctgctgcttttgactgtgagaccttccataagctccttttgctccaagcctcagttttctcctctgtgaaacagagaaaatcgttcctatcagagttcttatgaggatgaaatgggattttggatgtaaaatgcttccatccagtacctgctaaacaaaatgcttactaatggccgggcgcggtggctcacgcctgtaatcccagcactttgggaggctgaggcgggcggatcgcttgaggtcaggagttcgagaccagcctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctcaaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctccctagacagcacccaagaaaacctcatttggctcgctgaaggatgaagaccggattttcaccaacctgtacggccgccatgactggaggtgagacagtgcccttagtgtgttgggtcccggagcaaggtgtccccttcattgccttccctattctgtccaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggtaaggcctggcgtaaccctgggtcagactgtgtcctgtgacacccgggatctggctaggctccctttggattgttcttagggatttctgagtggcttcccggctggggccagatagagagtaggctggcaacaacacacaggctcccccagggccgcctgctgtccctcctcctgcctcggtccccgccgcaccagtgctgctctgtggctccaccttcacagtgcctgttctgaggctaagggcatggggtgaacaaggcaatgggcatctctggagtttggggtccagcagggataagaatgataaggggatattagagcaggggctctgccatgggtgcaggaccctgggacacacctccctgccaggaaacttgccccaccccctagcagccaccagttctcttcccatttccctgaaggagtgtttggctgccccacaactgtggccaacgtggagacagtgggggcaggtgtccacaaagagagcctgggcgggagggctcaggagacggggctgggtctaggggctgactaagggcctgggctcaggactaggcaggtgtgccggccccagccctgaccatgcatccctttggggaccgacttggggccccagggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcc

SEQ ID NO: 621 - DNA, 2851 bp, Homo sapiens
accgttgttctgctgccacctggaaatcctcccagagctcaaagcctgctgctctgggcaaagctgacaaggaaggacagattcagcagccaaccaaggagcataccttcatttgattcccttaaggcaaaagcactggctaaacaaagggagactatctgggagaaggtgttttcaccctttcaagctggggtgctttcaccaccgggaagtgccacgctgctttccacgctggaacaaggactcacttcctaaggccttggttccccaggagctgttggccagaagcctccctcggtgccctgcctcatgggcctcttcgttgagcatctcacaacgtggcagcttacttcatcagtgcaagcaagcaagagcaagagagaggactcaccagagacagtaatagcaaaacagaaggcacagtctttcgtaatccaatcacagatgtgacatcccatcactgttgccacatcctgtgagttagaaatggtggagccttactctgtcgctcaggctggagtgcagtggcgagatctcggctcaatgcaacatccgcctcccaggttcaagtgattctcctgcctcagtctccggagtagctgggattacaggtgcctgccaccatgccccgctagtttttgtatttttagtagagacggggtttcactatgttggccaggctggtctcgaaatcctgacctcaggtgatctgcctgcctcggcctcccaaagtgctgggattacaggcatgagcctccatgcccggccttgctttttatatttttgacaataacagagccacgggaagaaaggatgtgattaggggaagaaaaaaggggagaggttcatgttgtctttattttcattaatgaatgtctcaaacattttagggtataaatagcaatcagtatttaggaaaggaagctggattcacactacttggaaatctgggtctttactcatccatggcaatttttgggtatcatgtgctcttacagaatctcatcttatgatatagattcagtttacagctattctatgatgcttgagtatttcaaatattaagtacattgaggctcatgagaattgctaatctgccgtgtgaaactgcagagttgtttcccaagggtagagatgcattcacatccacccacatagtacaaagggggaaatgattacgctggcctggattttttgtaatagtcccgtgacatggcttccacattgctctgtgggctgtggttaaagaacctaatctagaacaagacaagacttgtagatttaaaaagtcacctaagctgtttctttcctagacaaatgggattctagtttgggttttattttattttattattttttgagacagtctcattctgtcatccaggctggaatgctgtggcgcaatctcggctcactgcaaactctgccccctgggttcaagctattctcctgcctcagcccacctagtagctgggattacaggtgtgtgccaccacactcagctaatttttttgtatttttagtagagacgaggtttcaccatgttagccaggatggtttcaaactcctggcctcatgtgattcacccaccttggcctctcaaagtgctgggattataggcataagccacagtgcccagccctaatttgagtttcagagggcaatttgtaccgtttggaaaagatgctggatccttcaatattactgctttagaaagatttggaactctgacccatatttagtacatgacctttctggggcgtggaaaaatatgctctgtcatctaatgtgatgtcaattttctttaaccttccatgtaaatagtgcgcattaagacatgaggtctactgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagagaaacatgaaaacatgagtgcatatgccaaacgtgtctcatgtgagcggcagagcccaagtgaaggcctctttggctatagggtgtctccttttttttttctttttgagacggagtcccactctgtcgcccaggctggagttcagtggcgcaatctcggcttactgcaatctccgactcccgggttcaagtgattctcttgcctcagcctctgaagcagctgggattacaggcgcccgccaccacgcccagctaatttttttgtttgtttgtttgttttttttgagacggagtctcacactctctcccgggctggagtgcagtggcgccatctcggctcactgccagctccgcctcccgggttcacgccattctcctgcctcagcctcccgagtagctgggactacaggcgcccaccaccacgcccagctaattttttgtatttttagtggagacggggtttcaccgtgttggccaggagggtcttgaactcctgacctcatgatctgcctgcctcagcctcccaaagtgctgagattacaggcgtgagccaccatgcccagagattattctttaattaatctcaaaagcctaacaccagggtagtctctctcagcctactctggcttgaaaagctgccc

SEQ ID NO: 622 - DNA, 3727 bp, Homo sapiens
agttgagattaatctacaggaggaggagaagaatcatccacaccactcttcgccacccggctgggagcaattccagaaggcagggtctgcttgggcagttgagaggccttgggtcatgccgcttattgaaaccatcagcaggaggagtttggataaagctgaagttccacttaggcgctcggtgatccatctgggaagacagtggccacagcccaacaggaggccggggaacctggaccccaccagccaagctttgagaagcagataggcttgaatgagcatggaatgtatctatttaaaaagcagctggaagtctgtcaagtgcattctggaaatggattcaggctaacagagtgttctgaatagagacgcctaaaacaagtaagtatgatctgttatcaatgcattatcactttatggtatacgattgattttcttaagtatgtgattgtagtgtctataattttgtgtttttgtacttagcaaccctttttcatatagatggaatcagaataaatttcatcctagttctatttccaaaatattattggtgcccctagttgtactgcctgagtgttgtcagatcaaggcttacaaactcacgggcgatgctgcagaatgagtgacaacagataatgccaattgcccagattgaatccagcaagaaatgacattggaatggctctaccttgtggagggaactgtccagtgcagaggacctgcctgagtattgcttacaatacatctttctggttataatgaagccatttatttgtttacatctttattattgccactttcctccactggcttggaaatccttagagcctagaacaatgctgggcttggagcaggtgcttgaaagcatattaccaaaatgaatgaataaatgaatgaatgaaagaataggcgaagatgctggtgcagacctcggtcttttgtgagcttggtgagtgtgaaccagagtctgagatccccggtttccctgattagacactgaggatcagacgttggaagcaccactgtcctgtaaggccccttctcacccagctcggcagcctttgctacacccctgtctttattaactgtcctctgtgagtccaccttgaaaggttctcacttacttgctttttctctctgcaggagccaaagacatagcaatggagaacgtgggtggtacagccctccaccctggcgagcagcacattagaatcacgtaggagcttaaaaagtactgactggcctggtctttttcggtgtgaaggtgggatgcaggcttcctggggttttcctctcgtacagccagagttgagaaccatctgagtagcgcttgtcacacttctggccacatcagaatcgtctgagggacttgttcactgcaggttgctgggtcccatctctagcctctgatccagtagcctggggtggggcacaggatgtcctgctgctggggtctgggcagcgctatgagaactgctgacgttggagctcgatcaggtggtccctcactccctgacccagggcatttgctgcttcctgtctctgccattcttttctcaacctggggcacttgcttttctcgctatgctgccctgccctttgctgaggcctgggctatccctggcagggtgcagaaaaaaaatttttaagttacttttctcagcccaaaggagactggaatgcttcacaagggattctacttgacaggcaattggaccacccaaatggcaaactaaaagcatagaagcggacaccagaggctcctggacctgagatgtggccctggaagtgaccagatgtggtctcaagagatgggggcccagggctaggaatgccgccatccggggaggccctagagcagagcagagcagctgtgggctggtgccaagctcactcctgcttctctctgcacgtctccctcattcttttctctctgaactgtgacccttttggcccctctgagtaccaggtgggacaaggtgacccctcagcacttgagtttacaccttagatgtgtaggtcctcacagaggccaacttatctccttctgggaccaaattccaaattcctaaagaaaaaacaaaccaaaaacggatatgataaacctatctcagtggtcagcccctggggcgcaaacattcccctgagtcagggaagggtgactgtaacacaggtatcattatgatttaggtgtggcaagactagcaggtcaggggtgcctgccattgaaaagactgtcatacagttcccgggtggaaggggtgtgccaggaggggcagccagaaggcagatggagggaagctgcctttatggtgtttctgctgggaggcacaggtgcggtggaggaagcaggcttaggattggttcgtgtgaatgtcttcagtgggctctggttatctggtacctggcccggggtgatgagggtagatagaggcccagaaggtgagagcctaatacccagagcggtcgggggggtgggtaggctcagggctggttggtttgggaagcatgtttgtgggcccgttggttaccgtctcaaggaatgggctaggcctgggtgtggctgtccttctaggatcagcaaggcagcaaatatcaaagcaccagaatacacaaagtaaaagactacattaatacagggtagtttacaaagaaatgggaaattgttggttctgagctgggtggggattgaaacggtgttccctgcagatccatttaaagtctctctgtaaatacgcgttggtgtgtaactgttccttgtctctaacctcagccagcccctcccatgccaggtgaggggtcttcccacctcccttttcctctctgggtgtccctccattatgatctggggaccaaggctggctgtagcagtgtgcctccatggcctagggcggttggcaaatgcaatttcttcggcagtgctggataaagtgggatgatgcagtgaccacacataatgtcatttctgatgaaagctggcatgccagcccgtgacaggacacagaggagcgtggattccccttcatggttgacttcagccaaggccatcatccccgctgccaaagcctgccctgattgcctgccctgggggagagaagtgttttgaagatgacaaatcaaagtcaggtcctgcatggagtttgcgtgcctgacagcctggctagcacaggaggacatgcaggtggaatttgtgcaagcctgttattttctgtaacacaatacacactgagaaggcaatgggtaccttggaccctgcaggccaattcaagcaccatcactacttttcagaagtgtggggcatagatgtcaactgagcctagcaagatgtcctatgttaccaagagactattagaaagcagagcaggtctcaagattcaatgaaacaattgcctggaagctggaagataatatggaagctagggatataatagagtatgttgctgggaacggtggctcctgcctgtaatcgcagcactttgggaggctgaggtaggggggatcacttgagcccaggagttggaggccagcctgggcaacacagcaagaccccatttctataaataattaaaaaaaaaattagctgggtgttgtggtgcatgcctgtattcttaactactccagaggctgaggtgggaggatggcttgagtccagaagttcaaggttacagtgaactacgattgagccacactgcattccagctgggtaacagagggagactctgtctct

SEQ ID NO: 623 - DNA, 2570 bp, Homo sapiens
aagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggcagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctcgtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccattggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggttcacaccgacggctccctgtggcggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgtt

SEQ ID NO: 624 - DNA, 2751 bp, Homo sapiens
attcgccgctggactttgacagtggtcaaaggctctgctcagttctctgtgcctgtctccctccagcactgccgaggttctctgccgaggccaaccagaaataccccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaaggaatatggggtggtgctggcacctgatggctcgaccgtggctgtggagcctctgctggcggggctggaggcagggctgcaagggcgcagggtcataaatttgcccttggacagcatggctgccccttgggagactggagatacctttccagatgttgtggccattgctccagatgtaagagccacctcctccccaggactcagggatggctctccagatgtcaccactgcagatattggagccaacactccagatgctacaaaaggctgtccagatgtccaagcttccttgccagatgccaaagccaagtccccaccgaccatggtggacagcctcctggcagtcaccctggctggaaacctgggcctgaccttcctccgaggttcccagacccagagccatccagacctgggaactgagggctgctgggaccagctctctgcccctcggacctttacgcttttggaccccaaggcatctctgttaaccatggccttcctcaatggcgccctggatggggtcatccttggagactacctgagccggactcctgagccccggccatccctcagccacttgctgagccagtactatggggctggggtggccagagacccagggttccgcagcaacttccgacggcagaacggtgctgctctgacttcagcctccatcctggcccagcaggtgtggggaacccttgtccttctacagaggctggagccagtacacctccagcttcagtgcatgagccaagaacagctggcccaggtggctgccaatgctaccaaggaattcactgaggccttcctgggatgcccggccatccacccccgctgccgctggggagcggcgccttatcggggccgcccgaagctgctgcagctgccgctgggattcttgtacgtgcatcacacctacgtgcctgcaccaccctgcacggacttcacgcgctgcgcagccaacatgcgctccatgcagcgctaccaccaggacacgcaaggctggggagacatcggctacggtttcgtggtgggctcggacggctacgtgtacgagggacgcggctggcactgggtgggcgcccacacgctcggccacaactcccggggcttcggcgtggccatagtgggcaactacaccgcggcgctgcccaccgaggccgctctgcgcacggtgcgcgacacgctcccgagttgtgcggtgcgcgccggcctcctgcggccagactacgcgctgctgggccaccgccagctggtgcgcaccgactgccccggcgacgcgctcttcgacctgctgcgcacctggccgcacttcaccgcggtgagtcttcgcagcctgcactacacggcccgccgcccctccgtctacacaagctccacgaggcccctgccccctgcctgtaacagctgtgcccgcacagcctcagccaggcccccaacttcccggcggcacgtctattcaggaaacctaggcccagcctttgcgggtcactctgcgggcaacatccctgatcctgtgacttctgcctatgcagcctcagctcagccccagacccagccagcctgtcctttccccagctcctaatacctctacctttccagccaaggcatggaccctgacacctgccaacagcccctctgccctcacaacctcagcctggccttcatgacttctctacccaagtcacaacctgtcaggctgcaccacctcatcctggcccgccgaaccttgacctcacccctgcccctacccgaaggccctctgtccacacaacatgaacctaggctgtgaccttttgccttcacaacctctgtccagtccttaatcctgtgttgcaattctctgtccagacaatctcaactctgaggttgcttgtttcgtccctgactccttaacccctgatgacaactcttatgccagcacaactttgacctgatgacctcatcccagcccttgatcgccatcactaaaacaattttagaatcacacctggacaatctcgtgctacctacatactgccactccatttcattaagctattgactagcacatccatctcggcctatagttggctttgtcctcactctctcactttgggccactgtcccctccctgatccagggttccaccaccaggagggcagacccagccacataccacaaccacccccaagcctcacactcccttgtctttttccagactgttaagccaagacctgccaggagtgtctctaagagatccaggagggagccacccccaaggaccctgccagccacagacctccaataaagacagcatgg

SEQ ID NO: 625 - DNA, 2677 bp, Homo sapiens
cacttccgcgtccgccccgcggcgtccggcggccgcgccgagggtctggcgggccgcagagggagaccaagacatcattgttttgaagtttctgaaagtgttgggaggcaaaaattcaggtgcctgggggagaaatggaaggccacaaggcagaagaggaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggtcaaatatagaacttaaaaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtacagtgcaattcttttatttcatggaagcaggtggactttaaaaaaaaagacaaagtaagctcaaatactgcatttctttttttagaaagtattcttttgagtcttacaatgtatttgtcatctcatgataacactgaggcagtttacttacaaatctttaaatcccatgagttgctagatattattaatagtttataattcagtaactaggtatgtttctgttagctaggcttatttaatttaattaaataagagttcatttagtacctactgtgcattggaaaaatacttcaaattaagcataaaatatgtaatcaaggaaagggagagaaaataatgttggagaagatgtctaaagagcccttataaaataattacaataatctttaaatgtacactttgaaaactggtcatttttctcaaactacagagtgagagttggtaataataatgctgttttatatccccgataagtagtttacattcagtatctcttagtcctaacacaatcctgtacgctacttaccattcctattttatagatgaggaaactgagtctcagaagggctttgacactttcataaggatcacaggttacgtgttctgttctatgcctaagcattttttttcttaattaacaaccatgtattgagtgtctgttaggtgcaaagtatgataacaagtcctaaaattggatccaaagataaataagacttattccatcctcaaataatcctgaaagctagtaaagactgactgccagtcacacaatggataaaagatatgggcctggtgtcatgcacctattgtctcagttacttgggaggctgaggcaggaggattgcctgagcccaggagtttgagggtggagtgagctgttatcacaccactgcactccagcctgggtgacagagcaagacataaaaggagaggaagaggcttttaaaaactgcattggctgggtgcagtggctcatgcctgtaatcccagcaccttgaaggccgaggcaggtggatcacctgaggtcaggagtttgagaccagcatgaccaacatggcgaaaccccatctctactaaatacagaaaattagccaggcatggtggcgcatgcctgtgatcccagctacttgagaggctgaggtgggaaaatggcttgaacccgggaggcagaggttgctgtaagctgagattgtaccattgcactccagcctgggcaacaagaatgaaactccgtctcaaaacaaaacaaaacaaaacactgtatcagctgttcttccttcaggtgtcgtgccagctccagtccttcttcctttcctcaactttgcccccctcactttccttcctttttcctttccagtcatacccctcaagaggcaggatgacatctttcagctttctattttatatttaatttactttgagacacttatgctcaagttggagaacaaactccatggtgttctctgtgtctctctttgtgcctctggactggcaagatgtccaggagcccactgccttagaaagctgaaggagggctgggcacggtgactcacacttgtaatcccagcactttgggaggccgaggcaggtggatcatgaggtcatgagattgagaccatcctggccagcatggtgaaaccctgtctttactaaaaatacaaaaattagctgggtgtggtggcacacgcctgtagtcccagctactcaggaggctgaggtaggagaatcgcttgaacccaggaggcagaagttgcagtgagccgaatttttgcaatcagatcttggcgatgaccttgagcagtaggatataaataactcccacatgcttagtgttccaataatggaacactaggcataaatgttaaacacaaaacaaaac

SEQ ID NO: 626 - DNA, 2301 bp, Homo sapiens
tttgctgcagacgctcaccccagacactcactgcaccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcggtgactgtgggaaccatctctgggggctgctgggggaggaggatacagggggcatgaccacattcatcctgacctccatgctgaatgtccttgcccaggaccaggtccaggaagctggccacacggttgcctgggtctgatggttgcaaaggagtttgggcagaggatgcccaaagaatggaagggtgaggccgggtgcagtggctcacgcctataatcccagcactttgggaggctgaggccagcggatcatgaggtcaagaggtcgagaccagtctacccaacatgacgaaaccccgtctctactaaaaatacaaaaattagccaggtgtggtggcaggtgcctgtagtaccagctactcaggaggctgaggcaggagaatcccttgaacctgggaggcagagcttgcagtgagctgagtggcgccactgcactccagcctgggcaacaagagcgaaactccgtttcaaaaaaaaaaaaaaaaaagaatggaagggtgttcctgggattgccacccggagggcagaggtctggggactgggcagagggcagctccagggatggggcagcctagtaatgctgcctgcattgcagctgcaccaccaccgcctgtgctgacgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgttt

SEQ ID NO: 627 - DNA, 2139 bp, Homo sapiens
agctctttgttctccaagcaggaaggcggcctcctgcccacccgccgcctccaagcgggccccctcctgcaccataaatccccccgggactgacaaccgcctcgccacggcctcctctgctgacaaaaggggcagaaatcatcactctctctttcctccccgacgaagggcagcccctgccgactccaggtcctacacacctccccgccgggaggccaggctccgggacgcctgcggttccctggtcccgcgccaacggcctggccttccctgccggcccgcgtgcctcccgccacggcgctagcggtccgagccacgctccctcgccgtccgagcacagccgtgcctcggtccgccacggcctcgtccctgcaggcgtcggccatccggccatgaccgcacggcggcctggccaacactgacgttttccttctactccgtcagcaacaggaagagagaacaaaagccaagactttccaggtgtctgaagcgcagaggaaatgctaaaaaagggtcgccccacccggctccgcctgcggccgccattttgtaccactcgagaagaagcgaccagggacggcggccattttagagcgctccactcggcggcggcagcggctcaactcaccttcaccgagaactcagcagctgccaccgcagctgcctcctcaggatccggtcgtcggggatagggaagggaggggaaaggggaacggaaaacaaaaaaaagggggagggaagggggaggaaggagtcggggacggcctcaaactcagctcagaggagtcgctgctgcagccgccactcggtacccgctgccacctccatagagctccgactcactgctggcgctaaggcgtgtctgaagccgaacttatcactcttggggcagccgaacccaccagagtctccccgaatggctccttcgccgcccaatcagcggcccggttgccgtctgccaccaatccgcgcagggcagcgaggaggagccacagggctgagctcggttgcggcgcagccccgccgcagtgcgcaaagccatattcgcgaagtctctgaggctgagccagtggcgtaaggggcgccgagcgctgtcgagatgagggttgcgtgcgtaaagccggagagcccttttgagtctgcgttggcgtggctgctgcttcttgctccagtccctttgttcactgagtccatatgccatgctccagttgtatcatccccttttccctcgacctcgttttctcaccgggaatatgggaagaaaacgcacccttacctcccccgaaccctgtgcgtggcgagtgagcattgcttttcttggcgccccttggagctgtggctgccctcgcgtgcctggcctctcccggggctgggcccttcgggttgaggcctggagcccccgggcgcagcgccgggacactacccggctccaggtcctcggcttcggcagccttagggaacccagaaagtagtggggaggaggcgagacgtgcgcccggatgccaaaggggagcttcattcagctccttattggcccaccccctgcagagtgaatgagaaagtgatgaaaggaaggggttgattttcttcgaaccgcacagaagaagctgcttttcccataggaatgtccggctggcggtcaccgaggaaaacaccctgtgtgtcagacttccgcgggtgtttggaggatttcgaattgctagctcctgtttttttttgtgttttttgtttgtttaagtgcacgttaaacattgtcagttgtgtattttcattttatttaaggttcaccataagaaataggattaagcttttcaaagccggcaagttgaactatttatacttaccaggtaatgtattgatgagtaccttattccatcgtttgcgacattgtagctatactaaaatggagtcatacttccataaacttaaacaacaaaaatgtccccatctccattttaacatgtagtacttttacagtgtatagtcaaaggcaagaatgtgtgtgttttaacatgaatgacttttaaagtgttcagtaagaggcaggattttcaaagacccaaacttaacctttgatgtgtcaaaacagctcttggtattagagcacctggtccttaatacaattttccggaaaattgc

SEQ ID NO: 628 - DNA, 1586 bp, Homo sapiens
aactcttccacagcaacccctacttcttcctcctgctcagtcgccacggaggccactgtggcttcctgcgccaggagcccttgccagcctggagccatgaggtcatcttggagtccttccgggccttgactgagttcttccgaacggaggagaggattaaagggctgagcaggcacagagcttccttccttgggggccgtcgtcgtgggggagccttgcagaggcgggaagtctcttcctcttccaacctggaggagatctttaactggaagcgatcatacacaaggtgaaagacctggcctgagaacccccaagtcctgcaaagaaaaacagagctgggcaagggggagtcctggaaagatggggcagactgaacagagggagctccagctctgtgctcctcattcagtccctctctcttaaattggtgccttgaaagagaaggaacgtcctgcgagcctgcactcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacaggacatatgtttccatgtgttgctaagattc

SEQ ID NO: 629 - DNA, 2344 bp, Homo sapiens
agtgtccagccctgaagccctggagagccaccatgtccccatcagggaggagcccaactgtgcagacagcttgagaggccggcatcaaggagaggaggatgaacagaaagagggatcggtgtgaggccaccccgtgggctggggccatgtgcccactctgccctcacctgccaggtgaggacacagaagcatgcgtgggccagcgcctctcccagccgcgcccctgcggaccccagccaggagctcctccttcctctctaaggaccaccgctgccgcctacctgtgcgagctgagcgcgcagcgccgcgagctccccctgcagacgcgcccgctcggtgcgcagcgccgccgtctgctcctgcaggacgcgcctctccgcctgcgcctcggccgcctcctgcccgccgctgagcctctgcggcctgcagagcacctgggccgaagacgctgggcgtgggccagggattgggagggcccgagtttctgagagcggggtcgttccatctaaggctggctctggcctcaacttattttctcctaaacggcgtgtccacagctgactcctctgttgtaggggtgcttactgtacggcaagaaatccagccccctgactccctgtgggcccctccaggctcagtttccccatctgtcagcgggggactggatggtgcctgggtctctgcaggcctgctcacctgcctccagcatctctctaggcctcccttcatgttgagggactgattctgcaaaggaccacagggcctcttccctgtaggcctgttcaccgcctcctggtgacagcgtaccctgccctcctggtcaccctcacctgtcgcaggggctccagcgatacctcagccttctggcacctgtgctccaagttggtgagctgttcttccagcagcttcccctgcttggccagaccttggctgtgcctcctgctctcttcaagagcctggcgcagcgtttccagttgctcctggggggaaggagacacagggtccacctggagacactgggggtgggaggccctgcagggaaaccctggcctcagggcatctgcctagaccgtctggcaggaccgtatcgctgggatgaaaacagcaagaacgtggttaaggacaacctgaagtgcgttgatcaggtgattgtgtttgcaatgtaacctcaaaggtgtggacccccaggaagcctgagacgaaagtcctgggggtctggtctagcgtgggcaaagacttgggcttggcaggttctctgctgcagccagtggtctcagagggcacatcagtggcatccctgccctgcctccagccttggtggctcctactgcccttgggataaagcctgaggtgaccctccccaaggctcctggagcctgttcggctcaggccctgcttgccccttctgccatcacactgcatgttctcctgcttcagctcccacctggggacatggctagtcccaaactaagctcaggagctccagagtccgtgaagctgggatggcccatgatccccgctgtgtccctcacccctgcgccctcttctcagcccctctgccttcagcttgtccaaaccgccatcatccacttgggaccagtgacagcccttcagtttcctcactgtccccaggtgctaccccatgatggctgggggtgcatttcacttgactatcatcggccatgccactgccttgccctgggcctgtggtgctcccagctgcccccaggacactgcccggggaactcgccatcccttcgatcacgtgcacctgctgccctctgtgcacagcctccccgctggcgcccccaccctacgctgctgccttctcctcctgcttgcaggaatcctgcctccctgtcatcccaggagggaggatggcacccgacgtgtcccctgagccccagagctggcagctgttgggccttgagaggaccccagacgtgtgaaggagattgcaaggcgtccgtcattggaagcttgttgactgcaagttggcctggtcaggtcttgatgagccccgagcccttgcaccttcctgagggttttgtgggagaaatggccagctccttctggggtggccggattctgaaaacactttttttttggtccgacactttgttacttcaaaaaaggaaaagaaggaagacaatgcttgtacctaagactgtgatgcttcacccttcgtgcaattttgaaaattataattttctatataattttccagtagaaaagcagaagttttctgcaaatatggcttaaatatttcatggcagttttaagaggtcccaaacctcttgtaatgactcagcttttatggaatttgaatgaaccgtaataattg

SEQ ID NO: 630 - DNA, 1879 bp, Homo sapiens
gcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccggaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggagaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 631 - DNA, 2791 bp, Homo sapiens
atgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaagtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaatt

SEQ ID NO: 632 - DNA, 1693 bp, Homo sapiens
tctgccccaccccgtcccgttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcaggtaacgccgggctgggccgcgacgccgggagacccttgggaagcacggccgtcctgctccctctccaaaccaagcggctttgaaagttcggcggaaactgcccattttaatttgagaggccatattctcttcgagtctgaaatgattccttagccctcccctttttctgtctctttttttggagacagggtctcgctgcggtggcacgatcgcggctcactgcaacctggaactcctgggctcaatgatcctcccgcctcggcctcctaaagttctgggattacaggagtgagccaccgcgcctggtccccgcttttctatttctggtttattcattgaggcacctagaagaaattagccggaaagtgtcctgaggaggcaaatgccaatctccagctccactgccgcccccgcgcccaccccctcagaaggctggtgacatctgttgaagcaactcagcaaactcttcctaggagtttcacccccctccccaccataaaaattttaagtgggtctccaaagtggggctcaagtgtcggtttctttgtaaagtttcatcgctcttgcattttaatggtcttgacatgaaaatttctggaagcctcctgatctcaccatggttgaaaaccttctctagatgtagtcaaatttccctagtccatttgattaatttacgctaaaagcaattattgcatgccctccatgtagcaggtccattataattcaataaaatagtatgtaaagcagccgggcgtggtggctcacgcctgtaatcccaacacttttcgaggcctaggcggacggatcacctgaggtcaggagttcgagatcagcctggccaacatggtgaaaccccgtctctactaaaaatacaaaaattagccgggcatggtggcacgcgcctgtaatcccagctactcaggaggctgaggcaagagaattgcttgaacccgggaggcggaggttgcagtgagccgagattgcaccattgcactccagcttgggtgacagagcgagactccgtatcaaaaaaaaaaaaatagtataaagcaagaggttgcttttctgtgaacgaatctctaaaactttttgccctcagtttggggcccctctggtcgttgttgtgtcgtttgtgtactctttactgtgggagagacttataggcagcctaagagttcccggagtcgttacagtcggggtgaaataaatacctcagactgatt

SEQ ID NO: 633 - DNA, 2071 bp, Homo sapiens
tttgatttaaatgtcaatggcttcagatggttaacttttatttctcattccagatggattaattaatgggtgttctaatatgttattgtattctttaattcaaaaatctatttcctatctccacctcacccatccttaatttctgaaatggggatgcattttgtaatggataaaaatgtacttatatatttgttatgtctaaaaaacattaaggcagagttatacactataactggtagaatcctagaaccaaagagaaaagagtatgctgaagataagcatacatcacagtagcaagagaaggatcaacagttttaatttttgttttctctctcccatttcacaataaccctgttagttttatttatcaaaggtcctctgaaataaataatgcaattctttgccatgactgtctttggcacatgaaagatgtcactgtaaaatttctttcatgatgctacaggttgagctctttaagtgagcaacactaggctagttggaagcttatcaaggattcatcagtggagaaatatccttttgataatacatgtaataaaattacttgaagtgcttagacttaggtcttgtttattaaacatgagtggaggtttcgggcatccttgtaaactttcttctgtttcaggacttgctcataaattgctgagagacacgtgtgtcgcaataaaactttgccgtctttaagtctgaggtgctctgtgtcaggcataaagaacaatacacaacaattgtttgcagttatcttaatctaaagctgtagtttcattgaaaatgaacaggccatgacttttaccaaatacttccagccttcccttatctgatagaccatcttttggaaacaaccaggtggatgttaatgggagaagtaattcactaaaaacagttaattcaaaagcattgttttggcatccaaatccaaaagccttgttactgtttctaatgttgaatcacactacagatctttgagaaagttggtaacattgcagttcatttaaagaaaatgttgtgggtaaatctcctttctggtttatttagcttattctttataacaatttttttaattagagaacattcctgtgtgggtgattcatggtgccttcttttctccccgccttctgcctttttagatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcatagtactgaattcagtgcttagaactgaagttattgagaggacagttttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatact

SEQ ID NO: 634 - DNA, 3424 bp, Homo sapiens
gtgctatgagaacaggttcagaacgcaggtgacctgaacctgtgaacgctaccctgtgaacgctgtctgctggaaatcagttttcttcaacatgaactgtactccctcttttcattttttagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagatcgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagctgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaggtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttg

SEQ ID NO: 635 - DNA, 2536 bp, Homo sapiens
aatgatcatacagtcttagagcaaatgaaagtagcagttgtccagagggggcttgggccagccatccggctggagagaccttcagtaggctcagaacagctgcgctcattcactcactgttccactttcttgtaatgcctgcaccagtcacagtgtggactggggaccagacgcagatgccctggctgtccttggcgggcctggaaagagtggagccccaagttgccggctggcaaacctccagctgtggcccgtggggtttgctccatggtggcctgggccacgcaggctgtaccagccatgagatgccatggagccaaaggctgcgactgtagctgtttgtgctgcagccaacctttacccagttcctgactgctgtttgtttggtttgccatgggtacttctggggacctcctggcagcatgctggcccgtgcaactctcctcatgccagttgtagggtccctgttcctgtttggccaaggaagggatttcctaagtgtatacatatttatttagctttgccatgttttggatggccttggacatagaaactcattgcacattagttaaataactaggccagcattctgaaagacccgactccagacctacttcggtgatggagatgggcacatgcagggtcagggtgctttgaaagagtcacacattcaccttccaacagagcagcctgaggcttccctagtcttgcagggtcaacttgctgaaagctcagcccttggtcccaaaggagctctgaggccgcaggcccagagccccgatgtccccgtgagctggtggcagggaagcggaaaaaggctttcacaccgcctcccccacatatgctcacagcctcccctgggccctttcttgcctctcacatggccatcctgtgggttctttggcctgggaggtgctgcttcagcctccctcggccttgaggtgctccaagacagcgtcagcacctgggctagaggtccgtgctgccctgtgcatcctcagagtttgactgtagtgtgcatgtgtgcatgcatgtgcgtgtgtgtgcatgtgtgtgcttgtgtatatgtgtgcatgtgtgtgcttgtgtgcatgtgtgcatgcgcatgcatgcgtgcgcaccgttattttctaatggactgtgcaggcatctgttctcctcatggaccaggaactcagtgatcagggactcccctgtttactttgatattccagctgccctccagagcgcctagcacatagtaggtcttcagtgactgccagatgagaggatatttaaatgagacggcagctttggagggatgacaacagattgtggtctaatctcacgatttttgcctgagagagaattggccctactcgaggcgggcttttttttttcttttcttttcttttcttttttttttgagatggagtttcactcttgttgcccacgctggagtgcaatggtgcaatctcagctcactgcaacgtctgcctcccgggttcaagcgattctcctgcctcggcctcctgattagctgggattacaggcatgtgccactacccggccaattttgtatttttagtagagacggggcttctccatgttggtcaggctggtctggaactcctgacctcaagtgatccacctgcctcggcctcccgaaatgctgggattacaggcatgagccaccgcgccaggccaaggcgggctttatttgtgtctgttggacacctcacatggcacctcacagggcgctggtttataaagacccaaaccagtgtcgagttccatgctggccccggcatctgctgtgtgctttcgctgtgtgtatacacgcggaagttcattccggaggcttccagggtagcctcccgggtgctgcagcgggtctcccgctcatcactactctgtacacaatgtcttgatacgctgaggattgaaatggagcagtgatcctgcctcaaggtagacagcaaaacccaggctatgtgggagtcagtgtggtaggactgagggcgtgcctgagggacggatgcaggggcagagagagcagcaggtgaaggctgggcctcctgctgaaagccggtattgctgagactccagggtcagccttccagctcctcctcctgactgaccgctggcaatgtaggggtgactgtcccagcctcctgctgcagggcgctctgccgtcagtagagaatcctcctctgtccccgcggtcccctccccgctgaacagcctggatcctgctttcacagggacatgcgtgaaatgggtcctgcgccgtaattactcctgctggagaccgggattgcaaagatgactgtcatgttgtctcgtgcatcttacatcttttactgtgattaaaaataaatgtcgtggggttcacgtcccacagacccttatgtactgcagaggtcaaactggggcgggtttctcacacgcgtcatcacgcgaggccagtgtccgtcggggtgtgtgtctacaagcacggggcttcgtggcctatctttatgaaccctccagggtgatgtgaagccagccacaaact

SEQ ID NO: 636 - DNA, 3185 bp, Homo sapiens
ctgggcaatggcgggcgcctctcccccagcctcgctgccgccttgcagtttgatctcagactgctgtgctagcaatcagcgagactccgtgggcgtaggaccctccgagccagctcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgacagctccttaaatgcttgaaggcaattaccaggtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccctgaaaaagaaaatcagagtttgcactatgactttagcaacctcagcagtgtgggctcattaatgaatggccccagcttcacctccaaaggaacaaaatacttccatttcttcaatatcagttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggt

SEQ ID NO: 637 - DNA, 3327 bp, Homo sapiens
catctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgactgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacacgcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 638 - DNA, 2503 bp, Homo sapiens
tcactctcctggatacctgttacttcctggccgtcaacccttaaaggaccccagtgaaatgatgtgcatatgaaaatgtagttcggggatgactctacctgaaaactccaaacagggaaaaagacctcaattacgagaggcatagtgacctgcctcacctaatcctcacccttgctgctcctgatgcaaaaccaggcacaacaagggaaatccatgtccaaagcatagtgtggtctcaactcttagaaactccctgggtttcccttttctcttagccacatgctaaccagttgcttctcagtgtttctcttcaatagaaaaataaggttttatatgccagcagcctatccttgtttttgcattttaaagacttagttatttatacgtattttaaaatgaaaaaaaaaatgtaaaggtctgtgctttggatggaaatcattattattgtaatcacctcagctatagacattttgcacagctgtggttctgcctggccccacctctagcatgttagttttgcagttagcaaaggttacctgagggaaatggagtgggcacctcccgcaccaacagtcctgtagctggaaccttcctgagttgactgtttagtaactccacctcaaagactgtgttcaaagaaaaatgttgtttgactggtttacccattgcctccactctggtgctgcacccagagaagtgccagatgtgagaactgggacagactgagtcatgtgccagcttcccttggaaaaccaaacctagtgatacttgacttccagtgctcagattttactaacgtttttcaggatatccactcatctgtctgtctcttccctacacttctctccaccctctttttgcatccctcttaccctcttcctgactgtggttcatagatccccaccagccgccattgtctgatcatcttgggaaggtagaggtgacagttctcgaaaagtctacagaaagaggcaattctttttctgagttccagtttgaaggcctggaattttcacatagcacttggtcgaaaatatcaagcctaaataggaagtcattttctgtgacacctctacatagctattacagatcctaagtcctagggcatcagctataaaaattggccagtcccaaagacacagtaagttctaacattctggtactatcatatttcaagtattttttctcactttttaaaaatgtttttctgaacaaaagtgaaacaaagccatttatcaaactgagatcattacaatcttcaacaagacaactaaaacagcttgatgttagatgggattctgtgaccgtttgtatactgacaggtccttccagtctccctccacagtcccacaagcggaagtattctacctgattccagagttcattccaacatgcagtagaatgaggtgaatgaagaaccaagtgtgggttttgttttcacagtgcacttggtcaatctagtttctctgagtagtgggctgtattctaagaaaagctttcacgtagacgtcaaagtctgcaaaagagatgagttagccactttacaaaaacctgctctgctttacaaaagatgcacaccaggcttcctttacaagtgaactccaaggctgcttgtaaagtaccacccttcctgcagactttgtgggtcgtgtcacttggcctaaacaagtggcctaacatatgcatgctcacagctagtagcatccctcatgcgtcctttgtcatactctggaaagaaaaaaactctgctatcttcagagaaaccatctattcatacttaaatatggaagcctttacaaggaactcaaaatacatttcatttcatttgtacaatgagaaaaaagatgaaaaggcaaggttgttattgcagttgacattgtcagccctgccttttggctttatgtaatttaaaatagaaagggggaaggaggacaagacagaagctcaactttagaaaccatggacatcacctccctctttgagaggagctgcttgtgaaccaggctccagtcttcctgtggcctctcacagtaaccctgcccctttcttacctcacaggggcaagagggactctaaagagggcgtaagcaatagaggcacctgcagccctccttcctcagcaggaaatcaatgtggagccccagagggacattttatctcagagagagcatgctggccacaggacccagtgcagccctgcttcctgcaccgtgggtctttcctgatagctgcaggcttgagattgcagcctcaggataggacacgttcagatgccttccagactacacacactatgcttagattcgagagtctttcctgaccttaaaatttgtcccttgcttactttcacactgcagaagatttatatatatattcatcattatttttgcagcagtacaagtggaaacttcaaaaaaatcattccctttcatgtcctggtctttttaagtcttgatatgtaaccattttcataaatatccaaacagagattgtcattcccctt

SEQ ID NO: 639 - DNA, 2529 bp, Homo sapiens
gttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgcccctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 640 - DNA, 3263 bp, Homo sapiens
aactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggatcggacaccaggagcttgtgttggaggctgtggaccttctctgtgcactgaattatggcctcgaaactgataatatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcactcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactaccatattttaagtgtagcagctttgactttgcaataacgtggcaggtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactctt

SEQ ID NO: 641 - DNA, 2706 bp, Homo sapiens
actcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaagtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagctcgtgccaagcggacctcgtgaaggacaacggccacaagtacttcctgtcggtcctggcggacccctacatgccagctgaacaccggaccatgacggctttcattctcgccgtgatcgtcaacagctatcacacggggcaggaagcctgccttcagggaaacctcattgccatctgcctggagcagctcaacgacccgcaccccttgctgcgccagtgggtggccatctgcctcggcaggatctggcagaacttcgacacggcgaggtggtgcggcgtgagggacagcgctcatgagaagctctacagcctcctctccgaccccattcccgaggtccgctgcgcagtggtcttcgcccttggcacgttcgtgggcaactctgcagagaggacggaccactccaccaccatcgaccacaacgtggccatgatgctggcccagctggtcagcgacgggagccccatggtccggaaggagctggtggtggctctgagtcatcttgtggttcagtatgaaagcaatttctgcaccgtggccctgcagttc

SEQ ID NO: 642 - DNA, 3324 bp, Homo sapiens
aaacagtaagagtcttgaacgtgtgtgctgtacaaaggaatgcagagatatacgtccgatgcagctttcatcttttgggacttggcttggccattacttctgactttcctcactcgtcctctccttgcccaccccgccccgtgtgcacccataaatctggtgtgcacccacagatcctatgccgctctgcatcccgagtgtcctgcagctgtgtccagtgtgtgacacactatcctggcagtgtgcaggcccatgttggacagggccctgccgcttccttggcaccttgtatgctttcagtaagcacttgctggacaaaggcagaaagggctgaagatagacgcagcccttagcagagatgtggatgaggcacacttaacgctgttagttcccatgcctgcagccagcttagtcttgcccgttttctcaccacctactctattccagcaagaagacgtgcctctgccatcgaaggtgtgaaatcctgggcgatctctcctgtgctgcagtagaaattagagcatgtcctgctttatgcaggctttgctttagttcttctgaagtgtatgaatctgaagtgcatgtgcggtcgctctttggtgcgtttggggtttctccatagcatcattccccctcctgactgtcattgtcgcccagcagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactcgagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccctccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgt

SEQ ID NO: 643 - DNA, 3482 bp, Homo sapiens
aggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgtgagtgttgggaaaccgtggggcaggatgagttacttggggctctctcaagccagcagaatctattgagtactcacggtgtcctgagcaaattggatgacccagataatgctcttagggtttctatggtggtttttttgtttgttttttgtttttttgagacggagtctcgctctgttgcccaagctggagtgcagtggtgcagtcttggctcactgcaacctctgcctcctgggttcaaacgattcttctgcctcagccacctgagtagctgggattacaggcgcctgccactatgcccggctaattttttgtatttttagtagagacggggttttaccatgttggccaggctggtctcgaactcctggtctcatgatccgcctgcctcggcctcccaaagtgctgggattacaggcgtgagccaccgcacccagcctcttctatggtgttttcatgcagatttcacaaaatccctgtggtgggggaggagaataaagtctcttcattttacatatgagtaaacttgatacccagcccatgaagagatcatagggataagaaaggcaaagtcaggactagaactcttggtccagtgctctttattttaaaccacagtgataggatcacagcagagaataaggaaattagctttgatacatcaaatcatccagactgatgccagggcttctggatgaatagggaaaatggctaagcactaaagccatataatcaccccatccagtaggaggagttaagaagatgatgaagtagaaaatgaaggaatagcccagtagatggaaaggaaaccaaaactggtgagaagcccaaagatgccggggtttacctctgggctgatgatcagaaaatgaaagagaaattctatgcttgagtgcaaccaggccttcctagaggacagagctcccagagtccccccttcagaaaggtgaatccctgaagaccgctggctaaccctctccctgcaggattttgacattgctgggaactttgatcccatgatccctgatgcagagtgcctgaagatcatgtgcgagatcctgagttcacttcagataggcgacttcctggtcaaggtcagagctgacaaggctgggagggcaaagttgggcctggcctctcacaagagaagatccttgtgcagagggaccagtagcctaagtgaccatgactattgcaggtcatgtaagaaaagagattcccccctcactatgcattggttccttgcaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggtaggtcctaggaggtaggtagaagatagtctgagcaggtggtggcacctaagctatctgatctccaagggagcaagtggtgctgctttgggcagggagcatctcacagaaatggagaaaagattattgctctttttcacagatttctaccccattatatgtaagttttatggatctttaatccataatctttctgcactcaatcctctgctctgggtctctacttccttcagggctgtcacaaacctgggctggtgtatccaagacttagatcttcctcatgatacggaatacttaacattttactgccttgtgccaggcactgtgcttggtgcttttcatgcattatcaaaatataattgttactacagccctgtgagagtagctaattttattaattgcattttccagatgagaacactgaagcattatagatcaaataatttgcttaaggccatgaaacttgtaagtggtagggtcagaatttgaatccaggcagtctgactccaaagtcttgccactaaccacactgcaatactgtctctaaatgggaagcatgtgtctgaggccctgggatccctcagatggctaccgtgactctctagcacctagagtaacaccaaggaagcctcttgtagcctcaagccctcctttgttgctgctggtcttaagtggctggttgcatttcatcttctgggaaatgctctggcaacctccccacagtcctatgccttttctctagggtggaaaccacccatttcccagttgagatcatttttccagtaggcatcttacattctaagaactatgaaaatagttttcctgaaaaagacaagggaagcagcagcagcattctcctttccccacacccatatacacgcctgtgccctgtaactgaagtgtgagaggcacagtgtcataaatgggtagatagtaagtggggactaaaactgtcaagggtgatctaattggggtgggctcatagtagtacttctgtgtgaatgctttggtggacccttaaggtactacatggaccagcctgggcaacatgatgagaccctgtctctacagattaaaaaaaaaaatttttttttttttttaaattagctgagtatggtggtgtgtgcctgtagtcaggaggctgaggtgggaggatcacttgagcttgggaggtcgaagctgcagtgatcacaccacggcacttcagcctggatgacagagaccctgtctc

SEQ ID NO: 644 - DNA, 2850 bp, Homo sapiens
agtgcaaaccagtccggctgctttagaaacaagttgttttctgcttccagaaccacccaggagcctgcgtgatgtctcttcccccacccgaccccctcttccctctgccggtctccttgctccaggatctgcacaagcagaggcggcacagggtttggcttccagttgggaaatgaagctccaagggcagccctactatggcgggctgtgtgacctgggccaagccccttgacatctccagactcggcttccacatctgccaccaccaggacactggattgaatgttgggtacgttgtaaggcaagggagacacagaagtcctaaaggcaataaagcttttccccactgcccctccatctggacgagtctcctgccaagcatcttcaagtcccactttgaaacacgattctgccaccttcctgttctgaggatctgggaaagcaagggggaaggggctattgggagtcccgcttgctccaggcccagaccaggaggctcaggcaggcttatctacttctgatgtggtggggggcccaggatgctgccagggtctcacagccatggtctcacagccactatcagcctgtcctcaagggtataagagaagctggaagcctagatgggcactgccctcaggcaacttccaatccagccaagaagaataaagagtaacacacaaaatattgggggcatgaggcaataactgtgggtacacctataaaaacctctaattgggcttacctggtaccagacagtattttaattggatcatatatagtgcattaattcagttaatattcacaacacccctatgaggtagctacaattattatccccattcgatgatggggaaaactgacatcagaagaggtcaacttgcccaagtttccagagctgaaaagcaacagagctgagatttcactgcaggtattctggccccagagtcttggtacaaatagtgttaatgaacaagtcttcttctggtaagagcaccccaattttcctttggagaacctccacttcctcatttcatgtgccatgggtgaccctacccttgagctcttgaggtgaacacatggacacacgatccagtcctgaccaaacagaatatctcacttccctggctacagttagtgataggttcaggattgtagcaatgacccaagactggcttctgagagtcacatttgagactgtggctcaaactcttagagaagcactcgtttttcaactgagacactacagtctttactactccttgaagacggactaccaggaagaaagccaacctagagggctgcaaagctgagcagtggagaacagcaagttcctgatgacattgtttgatggcctaaaccccattatacttccactggttatctccctggactttcctgttacacagaaattatcccttttgtgttgaagccaatttgaattggatatctgtcacttacaaccaaaaaggtccaaatgtgctagtgaacacagagcacatactgtgagcaactactctttttcttctttctttctttcttttttctgagacagagtctttctctgtcacccaggctggagtgcagtggtgcaatctcggctcactgcaacctctgcctcctgagttcaagtgattctcctgcctcagcctcccgagtagctgggattatagacacgtgccaccacgcccggctaatttttgtattcttagtagagacggggtttcaccatgttggccaggctggtctcgaactcctgaccttgtgatctgcccacctcggcctcctaaagtgctgggattacaggtgtgagccaccgcgcccggcccgagcacctaagcttttcaagacatttccagaaaaacaaatgcaggtaagaaaggatcagtcttcaaagaacttggaagctggtgagggattacaaagattctcaaataactttaaaacaagtcagaacacaattgacagcacaaggcagctacccgggttctctggttaatgcaaagggtgagaattttctatattggatggaacacatcagaaaagttctcacgaaggtggtagcagtgaaattggcctcagaagtctgataggatgttggcaggtgaaggcagggaagctacagggcagacagcatgaggaagggcccaggttcagggaagtatgggcatgcaggggcaagtgtaaattgatgggattgcctgggaccagaggaaaggtctaaaacgtacagtctgaggctggggcggggtggggaaaggatggttctgaggtatctgaagtatctccaaatatctgaagatattccccatggaaaagaaactaggcttatttggagtgaccccagaggacaagactacgactaaaaatggacgctcgcaaatggaggaagtagacctgacccctgactaaggaagatggtgctacctgtttggggcaaatgttcaaaaagaggctgtgtctgtatggtggatgctgttaaaagggactcagaaaccaaatgagagtctgaattagctgagtttaacattctgtgagttttgtgccagacttgggactactgcagaagaccctgggagagttgggattgaattccaaaggcagtgctgatggacactgacttgaggagccaggaaagagggcaggaacagtggtggggatcacagcctcacctgtatctgtgcacttctataaattcacagactgggaatttttaatgtgaactggatattagatgatgaccaggaattgttttaattctgttaggtgggataataccattcactgtgctgtgtaagataatgtccatattgtttagagatgcatactgaagaatataggatgaaatgacat

SEQ ID NO: 645 - DNA, 2608 bp, Homo sapiens
ccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttcccttggtggccagcccgtattcttactataactgtgagccggaaagataacggccttttagtccgacaggaggcccgtatttcatggtttgggtctccaacaacatctttccttgctctttcacaactctccccctttttagaaaacttccagtcacgctttaataagaagagaaagggcctgtatcgcaaggctatcacagaggcagctaaggctgccaagcagctgacccccgaagtgcgggctttgttgacacagtttgaaacgtgaacatgggcagtaaggtaggcaagaccattggaagtcaccacagattttctagtctagttaggaataatttctacaaaatagcgtggccagattggagagagaagttgcactcagttggctggctttttaatacttaccttatagccatttttagactgagagcttaaactgaacatataatcaaattttgtgttaaggaagtgagattttagcagtatttttcagttttgaagttcgaaaccatcccaaggcataggagccatagcctcaactgaaattgaatttttgtagggactgttaattgccatttgtacctaatactgtatatatacatatatatacgtgtgtgtgtatatatatatatatatatatatatatatatatatccgtgtatgtatatatacacacatatatatgtatatatacacatatatatatatgaaatacagcctgtcactgtgtgacacagattgcatatttgggattgcaataagggcttggtgagctgggggaatagtggatatttaatgactacttgttttttaaataatgaacacttagcctttctatgcgcataatggtgtaaaagttagatggttaggtgtttgacaaacagatggttgcaattcagttacagactggggaaatagcccagtgtttgggattaaaactgtcaagactggataggtgttagtcatcactgtctttcgtccagtggggatttaataaatactttcaagcttctggtttgggagtttagataggtttgattttggatttgtaaatagtgattgctaaatttggtcagatttctcctgactggctgttcctaaattcttaggatatgtcccagtaaaattatactttgtgaattaattgtcatatgtgtaattgttgcattttggatgtacctaatttgataattaaaacaaaataatttccgtttaaggtatctgtttgcaggtcagaaaatgagaaaatgtaattgtgtaatgctctgaaatgtaaaaaaaaaaaaaaaaaccaaaaaaaagctgtaaataaaatcaactaaatcc

SEQ ID NO: 646 - DNA, 1714 bp, Homo sapiens
aaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacagttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatcc

SEQ ID NO: 647 - DNA, 2304 bp, Homo sapiens
acttccgggccctgcgtggcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagacatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccagcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatg

SEQ ID NO: 648 - DNA, 2257 bp, Homo sapiens
attttttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggtgactcaggggttggaaagtcttgccttcttcttaggtttgcagagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaaacattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgt

SEQ ID NO: 649 - DNA, 1957 bp, Homo sapiens
ggtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttg

SEQ ID NO: 650 - DNA, 2020 bp, Homo sapiens
gcagactagcagtgagtcaacagagccctgtttgccagctctgttgccagtatagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaagggggccccactgcaaacttgaaattacttacctgaaggtgatgtatatacctaggctccagctgcgctcagccacacctgtcttaacattcagtttcggcactgagccagctgcagtgttgtcaggggtccccaggcccgtggtccctaaccacgatgggacatggtaatcggctgctggcacaccacctgcccagagctacaggaggtctggttctggggtggagttggtacagtttctgagtatgggaacttccctccccaagtggtgggaagttacagttaactacagcttactcaactatcacttccagaggtttagtgtttttaatatgggaaagaggagaaatctcaggtctaatcagggttctgcccatcagcttttcactgaaactttcaactgtgttttgttttttgtttttttttccatctttcagtttctagctgtgtttgccttctccctccgcgttccctcctcttttttttgcttttggtctcctttccagcttcatgtctccatgagttcagctgtacctcatctcctgttaaagcagatcatgtccactttttcttactgaccttactctaagctacagtagctgagggaggtacggtgaagacatgtagcgtttgccttattcggagcctgaggagcccagaaacccatgctgtgaatcccaaaactcagcgctcctcaagagctgtgaaaatcatgatactttgtcacaattttgcctgaaagggtctttggcacgggctccagagccaacctgaggtccattccagatcccactatctgggcgtgagacctcccccgtggctccttccttgcccactgagccaagagcagcagggagcgtacaggacgggagcagcagatccaaggccgcggtgcagccaatgaatgcacggccgtcgctccgtctccaggctggaattccgtctcataatcaatgccatgtacattaagatctgcgaaagaccaacttttaggcagtgatacttttctcccattccctggggtggggggagtatgcagttggtgctttctgtaattcccttgttctgttttgtttctgtaagcttttcccctggtgtcatggaaaggacttcttaaataaccacattgtgggtggctgtatccaaagtttaaataattggccagaagtgcagagtatcctttcctggattcgtgtcagaaaagggctccttgccacaactgaacttactgtataaaaacctggctagggagatttaattttactaaaattacagtttaatgttaccgtctagccacaaatcaagcagcaaaagctattttgatgatgaaagggggtccccgttgagctggccatctagtgcagtgtgctctcagattccatgtttgttgattgtgtgtcttcacaagcccctctctggtgctgaattggatttgaattcttggtgagaggcctcagcatctccttgggctggtctgggccagtaaaaatagctgcctgacatgtttatatattatcatggtcagtagttcaatgaaatttgtacatttttggtaacattggtatacatgatgcccctgcagttccttttctgtttggtggtttgtgactctaagatttccactgttatgtgtgttaatttatgaaaataaatttttttgaaaacctttc

SEQ ID NO: 651 - DNA, 2998 bp, Homo sapiens
tgaaatttgaaatggctgacgggtcgctgacgggcggcggtctggaggcagcggccatggcgccggagcgcacgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagcctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcggaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaaatgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtggtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctc

SEQ ID NO: 652 - DNA, 2764 bp, Homo sapiens
agaggcgccgagcagccgggagctccgtcctgcctgaggatgcggggcccaggctgcatccccccggccctgctcgcctgctcatcacacggaggccggggacagggtcacggccagggagcctgcggggctaaaggagcgggccgggagctcaagagctgccgccgggcggcgaggaaggagccccaggcaggccccgggcggccgaggcaggggaggagacggctggccctggttccaggtgagcagccccgcccgctctgctggaggccccgcttaccaccggcgggagatgcgggtgcaagccctggggcgcacgtggccaggccactgccacgcccgagggacgggttttcgtcgccacctcggccctggtgaaccctgtgactggagtgcctcccaatcccaccgtgatgcccacctcggggcgctgccaggtgccaggctaatgcgtgtgatccacagtgtgctgagaagtgctgactgtcattgtgaatgtccgtggtggggtgacgcccgggcagggtgcactggcctggttccagaagacctggcctctccagctcccacggcgcgcccgtttgctgcgtggcccatgctgctggcggctgctcctggctgagtcattccaagacgagcgtccagtccgcgctctctgccgcccttcccagcgctgcccggcaggccccgggaactgtgcccagctgtgcccgcttagctggtgtatgacctgcctttgaacttgctgcaaagaaagatgtggatctcctgttactggaaaacaggaattagcttgtctgcttgaggatgtggttggttctttataaaaaggatacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtggtgctggggagcgggagaaggtgccggccaaccccgaggcgctcctgctcatggccagctcccagcgtgacatggaggactgggtgcaggccatccgccgagtcatctgggccccgctgggcggagggatctttgggcagcgcctagaggaaacagtccaccacgagcggaagtatggcccccgcctggcgcccctgctggtggagcagtgtgtggacttcatccgggagcgcgggctcactgaggaggggctgttccgcatgccgggccaggccaacctggtgagggacctgcaggattccttcgactgtggggagaagccactgtttgacagcacaacagacgtgcacacggtggcctccctgctgaagctgtacctgcgggagctccccgagcccgtggtccccttcgccagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttggacctaacattctgcggccacaggtagaggacccagtaaccatcatggaaggcacttccctcgtccagcacctgatgaccgtcctcatccgcaaacacagccagctcttcacggcaccggtcccggaagggcccacctccccgcgcgggggcctgcaatgcgcagtggggtggggctccgaggaggtcaccagggacagccaaggagagcccggcggccccggcctgcccgcgcacaggacctcttccctggacggggcggccgtggcggtgctctccagaacagcccccacggggccggggagccggtgcagccctgggaagaaggtgcagaccctgcccagttggaagtcctccttccggcagccgaggtccctatcgggaagcccgaaggggggcggctcatccctggaggtgcccatcatctcctccggcgggaactggcttatgaacgggctgtcctccctgcgcggacaccgccgggcctcgtcgggagaccggctcaaggactcgggctccgtgcagagactctccacctacgacaatgtgcccgcgccgggcctggtccccggcatacccagcgtggccagtatggcgtggtccggggcctcgtccagcgagtcgtcggtggggggctcactcagcagctgcacggcctgccgcgccagcgactcgtctgcccgcagttccctgcacaccgactgggccctggagccctccccgctccccagcagcagcgaggaccccaagtccctggacctggaccacagcatggacgaggcgggcgcgggtgccagcaacagcgagcccagcgagccggacagccccacccgggaacacgcgcgccgctccgaggccttacaggggctggtcactgagctcagggccgagctgtgccgccagcggactgagtacgagaggagtgtgaaaagaatcgaagaagggagtgctgacctgagaaaacgaatgtcccggttagaagaagaactggacc

SEQ ID NO: 653 - DNA, 1881 bp, Homo sapiens
aaaaaaaagcctgcaaaaacccaaagagttcgtggcgctggtggctccagctgttagtttcccgggcagtctccgggttggatttgcaccctggggtctacacgggttaaaaacgcggaaaaaaggcgacgaagaaatacaaactgccagggtgtcgaaatgaaaggagcgactgtgaaaggggtaagggaaaatccaagccatctctacggggaggatccagaaagcaccagccgcgccagggggtcaaccaactccgacaccgctcggcgtcagctgggcgccaccaggcgcggacttcggagcgagggcaggtgcgcgggccggaagcctcgggcgctcacctggcacctacctggagctcacctggcgcccgggccccgcgccgccgccccccgcccagcccgccgcgcccgcacctcgcggtccttgaggcccagcaggagcacttcctccatcagggtcagccgcgtttccttggagtcgcccttgtcgtcgtcgtcctgctcgtcgcggcggctctgcgcgtcgtcctcgctgctgccggcgccgccgcccgccgcccgctccttgtcggcggcgttgcgggaggcctcggtgcgccgctgcaccaggccggagctgcgctgggtcagcgaggtcatggctcccgccgaggcgccgagccgggccgagagggtcgcaggaccgaccgggtcgccctcctcctccccgcgcggcctccgatccgggtttccgtgttaaatccggacgccggggcgacgtccgtcggcagcagggccgggggcagtcatgaggaaacaggtcagggcgaagcgggctggccgggcgtcggcggggcaggagaggagcgccttcctgcctgtggccgcagtccccgaaacaccccgagctccaaggcggaggcggcggcggcgcctttccaatatggcggccccggctgacgtcaccggaggatgtggcagagtcggcgcgggagagctgggccgggaggcgccggaagcggcggccggggatccgctgccactgcagcctacacccttcccggccctcggtgcttgtcttttctttggcgttcctgcgccccctgacccgcggtcctgcagtcctgctcccgtgacgtgccctccctccttccgttccccgtttccccttcactacccagggctggagcctgaacctggcggggccccccgtgaatggaagagcctgggccacgcgaaggtggaccccactcagcctccagccgtgccctccacgccccagacaccgccgtcttcggaggcgactccgcggtcgtgtggacggggtcccatttggactccggggtctgcaggatcggcaggaaggactttgctctctgctgctgggcggggaggggtacgctatctgccgggactccctaaccctttagaaggagcaagtgcgtccaaatggtttgaaagtggacctttattgttttccaggagtaagaagatagaacagttgaccagttttgtttgtaaaacttctttccttgcctcggacttgtgctataaagtgaccagggcgtagtgagtacagttagtaccgcacacgttagcacgctcgaccttaacgatctttttatagagacaataaacctgcagcgtttcatgccacgtctttgtacgcatcggatgtctctccgtgtagttactaggtgaaatcctcttggcgtgcgcaaattaggttaaaaaaatagctgtcaaacctgagacaggagttggaggagtagagggtggcgcttgttaagtgaaacatttaaccaggaatggtattgtgtgccatcctgtattaaacaatgtatggacagagtggaacaacagcaaagcaaaaaataaaaattttttaaaaaaagtg

SEQ ID NO: 654 - DNA, 1934 bp, Homo sapiens
gctgagggtggtgaggacaggcctagtgtgagccggactggggcacctggtgctgagggtggtgaagacaggcctagtgtgagccggactggggcacctggtgctgagggtgattaggacaggcctggtgtgagccggactggggcacctggtgccacccacagccagcctttgaccttcagggactggttggggctctggttgcctggggaggggtctccagggcttcctgccctttgagcctgggccagcatcccagcacttggcaggcaggagggggttcttggggcttgggccagcctgtcccttcctgcctcctgtgtccctctgtccttgctcatcacttctgtgctggggacccttctctcttctctgctgtccctcaaggctgtgtctggaagtctcggagggcccggttggtgggccagtgatctttgtgcttgctgagctggaggacaggcgcaggcatgctgtttgcccatcccacactctgatgggcctgctagccatgcctccctgctcacacagctgcgttcttccctctgcaaaaagcttagagatggattttgacaggagggacgtaaacataatcctggttggcatcagcttgggtctgcagtggctgtgactgcccaagggcctcttggtccccaggcccacctggctagggtgccagtggggtctgctcctggcttctcccagtgggccaggcaaagcccatgcaagagtgtgtggaagtgagctggagccctcttcagggctcgtgtggcccgagagaggcctgtgttctctgggagggcacagactccatcaagatggagaacgggcagagcacagccgccaagctggggctgcctcccctgacgcccgagcagcaggaggcccctcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggaccccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaag

SEQ ID NO: 655 - DNA, 2213 bp, Homo sapiens
ttactgtggaaggtggaagagctgaggagggcgcccgacaggatcccccaggacaccctggcccattcggcaccattcgaatgcatgagatcgcaggccctgtgccggtgcccggggcatgaggggcctgcccgtcctgcagggtgctgctcagatgcctcgaccctgggaggcccctcctggccattcttgcaggcctgccccagcctgtgccttctgctggggcagggcctcaggcagcagtggacattggccaggagggcgccgctcaggttgggagaggcccgtgggggatcagcctccccggatcccggggtggggccaagttacacacagagataatgcagactcaggcagtgcgcaggcaaggccggagtgccgagtatggtacaggaaacgcagtgtgcgcagctgcgctgcaccgtggtccacacagccaggctctttggtgtgtttcctgcacacaaggacattcacaagccctcagcatcgtcagaatcagggagtggacaggtccctgcaaggccccactgcagcctgaccactgtccccacgaggttctgagagcggagtctgatggtgtcacgcccttccccaagccgccgtctctcctccatctctgtcagcctgtgcaggctcctggcccctccgtgctgtgggcactcggactgctttgcctctggattcctggtgatgagatcctgggtgggcggggatagcagggggtgaggctgcgcttctgcaggtgtcctggcggcgggtgtaaaatctcaccctgggcggtctctggtgacgtgaacgctgacggtttaattgatgccgtgtctgcagcctcccctgcaacgctgtcctttctctctattatgattaatccgtgttctgtggggcgtcctttaaagccatggggacatccacgcgcaccaggcttccagctgcttgtctgagcctgagctgtggggccgcttgtgccccaggccatctcctggcactgtcagctcccaccatccccccacaaccctccccatcaagcaggctcctgagtgctcgggcacggcctcgtagccctggagggtcgcgatctcctacaagcctctggtgttttccctgcccaggctggagctggccgattctcccaggagtcctggccactttgaatggaacacggtactgagaagccgaggtctgggtgctcgggatgctcatgcccatggaggccgggacgtcaaggggcttccaactccagcctctcaagggatggtacagcggcctgggcaggggcggagctgagaacagaatttcacccccgaggttctcggactggagctccagaggagccgctgcccaggggcacttaccgtgtcctttatgaaaacagaaagttgaaaaccccagatgtctaacaatgagcgaatgatttggcgagctgtggctcggggtctgccatgaattcttggctcctggactgtggactgggggtggaggacaccaacaggaactcttagagggaagctggaggaggtgggggagacagagctttggaaaaagagcttcgactttgctcttgggtggaggagacgaggggagggcacgcagccagggaccacgggccgcaatgctccctccttcccagggtccacgggcggcaatgctgcctccttccccgcgtccacgggcggcaatgctccctccttctcagggtccacgggcggctggtgctttttccttgccggcgtccacaggcagcaatgctccttccttctcagggtccacaggcagcaacactccctccttcctggcatccagggcggtcggtgctccctgctttccagggttccaggggaagtcccaccccctgaatcttgggagctggggaagaggtgggaccctcgaggacaggccgtagccctcatagccagccacccctaagggagcatagctgctccacacggcggaattctctccgcacagacagcgcagccctgacgcctccagacaccccttcttgccgatgcccttttctagcttgatcttgatggttcctagagcctgggggtcaagtgttccctggctcgcttcctgtaacatcaactggaacttttcaatgtggtctaaaaataatcccaccagcactttgggaggccaaggcaggaggatcgcttgaggtcagaagttcgagtccagcccgggccacgtagcaaaacctcacctctact

SEQ ID NO: 656 - DNA, 2313 bp, Homo sapiens
tgtgcttttatctgtcatcttggacttctgcataagggatcatttagagaaaggactctgactaaaaacaaaaagtctgaagtcctgatgtgatccaaacccttcattctacacctgctcagagggacagggcagcctgccctctccagatcctcacttggctctgtctctggtggggccactgtctctagttcctctttctgcggggtaactgcctgctcctccatctccttgctttcttctttctctgcaaaccagaagcaggaagagactgtggccccaggcctggcccagcccagccctgccctggcactctcccttacccgtctcactctctggccacagtttgggtggctgtagccccatgtaagtcaaagacagatccagccgcacctgggaagcaaggcagagggaggctgaaaggagtgcacctgtgctgaggggaggggcggttgagggtggctcctcatggtccaccaccccctacctggggtgtgaagacgtatttatagagcttgaagtggcggaagtaagtgttgaccacgtagtcttccaaggccagcagctgttcctctttgaagaggtcgatgctgaaaggaggccgctgtggtggtgactcggaattagaaccctgactaccttccggagccctggctttgcctccaaaagcccagcaacaggagcaaggagagcccactggggtcttcacaagaagataagggtgatgaatgtgagagagactgggtgagaccttgtctggggatgggtaaagtttccagaatgttccaggggaactgaccctgactccatggcaaaaaaggacactggtgaagtagcggtagcactcctccacgttgcccaagggggttgctggtagggaaagcaagatgcagcagtgaggccctctctggtatccattcattcacttcactcaacagctgtttatgaccatgagcttcagaagcagacagatctgggtttcagcactggcttgtttccttaactcatgtaacaaatactgaatacccactatatgcccactgtatggttttcggcactgaacaagacagacaaggtcctgcccttacgaagcttatattctaggggaataaaccaagaaatagatcatttcagctattaaacattctgaagcaagagctattaaacattctaaagcaggtgttattgtgcactatgcatatatttgcatatattatttctcagaacagtcctgtaaaatgtgtgctgtatccttaatttctagataaggaagcagtggattggaaagctgatggcttgtgtatgacgatgctactaataatgacatattccaggcagaaatcccctgcttctgcttcccatggtcacttgtgccaggcccggttcctcttctccctggggctcaaacctggtagctgccccctctcaccaatacaagccttgtgaagatcctggagcagggcacaagccgctgacgtctgctccagtgagaagccctgctggcggcagaaaatgagcgcgtggcagaagaggtccagggtgatggcgtccctcaggctctgctcaggacaccctagctccagcagctcagccagcacccttgggagggagagaggagtgagtgacaactgggcctcctttcatcaccctacacccaccacatgctttggagtcagccattcctcatgttttcccaacctgacccctcagcctttgccaagagctcttcccacgcccccctcagtccctactccctcatctcagcattggtggtcttctccagctggtgcatggaatggacgtccaggtacttcctgttatagtaaaagaaagagtattggtggccgttacctatcatgacagggctgtgacagctagtgcgtgagactgggagttggccaccggcgtgaagctgggctcttttgccagcttgctgtgtgactatgcaaatcgttaactctctgggcctaaatgaactcttatgagcctctccatttctaaagcctagggttaggaatcttgaattcttttttctgctctgccactaccttgtatgaccttggtcaagtactccctgtggccctcagtgtccccctctgtacaatactccttagcggccatgagactccatttacattctgtctttggctctttttttctcacactgcctcctctttggactggagaggctggaaagccaacttccagtcacctggagtaattgcatctccaggcctcagtctcatctgtaaaatggggatgccctggccacagacaggactgttggggagacaataaagaacgcaaatattc

SEQ ID NO: 657 - DNA, 2343 bp, Homo sapiens
gtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataggccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggc

SEQ ID NO: 658 - DNA, 2427 bp, Homo sapiens
ccaaagaatttcttgtaggcctgaaacacatactcctaataactatgggaataattttttccattcatcattactcacacaaaaacaggaagtacacatgagagaaaaatctttccaatgtaatgagactggcgaagcctttaattgtagctcatttgtaaggaaacatcagataatccatttaggagaaaaacaatataaatttgatatatgtggcaaagtctttaatgagaagcgataccttgcacgccatcgtagatgtcacactagtgagaaaccttacaagtgtaatgaatgtggaaagtccttcagttacaagtcatccctgacatgccatcgtagatgtcacactggtgagaaaccttacaagtgtaatgaatgtggaaagtccttcagttacaagtcatcccttacatgccatcataggtgtcacactggtgagaaaccttacaagtgtaatgaatgtggaaagtccttcagttacaagtcatcccttagatgccatcgtagacttcatactggaataaaaccttacaagtgtaatgagtgtggcaagatgtttggtcaaaattcaacccttgtaattcataaggcaattcatactggagagaaaccttacaagtgtaatgaatgtggcaaggcttttaatcaacaatcacacctttcacgtcatcatagacttcatactggagagaaaccttacaagtgtaatgactgtgttaaggcttttattcatcagtcaagccttgcacgtcatcatagacttcatactggagagaaatcttacaaatgtgaagaatgtgacagagttttcagtcagaaatcaaaccttgagagacacaagataattcatactggagagaaaccttacaagtgtaatgagtgtcacaagaccttcagtcacaggtcatctcttccatgccatcgtagacttcatagtggtgagaaaccttacaagtgtaatgaatgtgggaagacttttaatgtacagtcacacctttcacgtcatcatagacttcatactggagagaaaccttacaaatgtaaggtttgtgacaaggctttcatgtgccattcttatctggcaaaccatactagaattcatagcggagagaaaccttacaagtgtaatgagtgtggtaaggctcacaatcacttgattgattcatcaatcaagccttgcatgtcatcatagacttcatactggagagaaaccttacaaatgtgaagcatgtgacaaagttttcagtcacagatcacgccttaaaagacataggagaattcatactggagagaaaccttacaagtgtaatgagtgtggcaaagcctttagtgaccagtcaacacttaccatcaggccattcatggtgtagggaaacttgactaatgtaatgattgtcacaaagtcttcagtaacgctacaacgattgcaaatcattggagaatccataatgaagagagatcttccgagtgtaataaatgtggcaaatttttcagacatcgttcataccttgcagttcatcagtgaactcatactggagagaaaccttacaaatgtcatgactgtggcaaggtcttcagtcaagcttcatcctatgcaaaacataggagaattcatgcaggagagaaatgtcacaagtgtgatgagtgttgcaaagcctttacttcatgttcacacctcattagacatcagagaatccctactggagagaaatcttacaaatgtcatcagtgtggcaaggtcttcagtccgaggtcactccttgcagaacatcagaaaattcatttttgagataactgttcccaatgcagtgagtatagcaaaccatcaagcattaattgacattggagtcaattcagcattgacttgagtttgtgttgacttaacattgagttcaagccttaattgacatgcaggtgtttatgataagaggattgggccaggtgcagtggatcacgcctgtaatcccagcacattgggaggccaaggcacataggtcacttgaggtcaagagtttgaaacaagcatggccaagagatgtgagccagttttcccagcctgtttattattattttttgagatggagtgttgctcttgctgcccaggctagagtgcaatggtgcgatcttgactcgcagcaacctccgcctcctgggttcaagcgattcctctgcctcagcactttgggaggccaaggcaggcagataacaaagtcaggagattgagaccgtcctggctaacacggtgaaacctcgtctctactaaaaatacaaaaacttagccgggcatggtggtgggcacctgtggtctcagctactcagggggctgaggctggacaatggtgtgaacccaggaggcggtgcttgcagggagccgagatcgtgccactgcactccaggctgggcgacagagtgagagtctgtctc

SEQ ID NO: 659 - DNA, 2035 bp, Homo sapiens
tgtgcaaagccctgcccttggtgacccgcctttagtgaccagtctgcctcttgggtcttcctcccaggccttgtctggcacgtccacgtggcccagccctcatagagaccacgctggctgtggcctgggtttaatctcttaaagaagccaatcctttccttgcctgtttggcatttcctaaaacatccctcaatgagggaggaaggcagggacaccctggaacgattcgtgctttcctttgggggagtgggaaggtaggtgggaaatgacaagatgagtgaggagttggcacttggccaaacagaggagcctggaccccaaggcttattctcagaggaggcccaagagaggctgaggaagagggggaacaaccctccggcgggggaggagggtgagacctcacactggcaagttcaggtccagccacttcctgaggctgctgggtggggccgcacctcacggtccttccctgtagaccatcttcccgggcacattgctcctcagaaaaggctctgggagggtctcagtggaagctggcagctgtgccctctggccctgacttggcctcttagggtattcctgggaccctccctctgtccctggccttcgtcttcctgaagtttccctgggaggcccaacctcctgcccctctcagggacagaggccagcagaggagccagcttacaggatgggagctgctgaaaagaatttttttcccttaattttatgaacctctccctcttcttcctctaattgtgaccgtttcctgtgtcagcctgtattcatgttttcttggacatctaacaattgaaacagcttttccctttcagaaacactcacattcaggttactggctttggtttggtttttgttttgggtttgttttttttttttttcatctgctgccaattaattggggaaaaaattgagctggatttctttgagagaaaagaaaagctcctgccacacaacgtcgcgccctcggcattttgtctgagaacctccagcactagcggctgtttctgtgtctcccttctttgctggctttattattgaccataatgcctgcccacttgagcaactctgtccttgagcgctgaggagtcaagggcgcttctggcagccccccaaacaggatggcgcccacagaaagaaaggaggctttgtaggggaagagggccccaccgcctgccagtcccgtcctgaagtcagaagaatggcccaggctgacaccctctcctggagagaggctcacagcgtagctgttcccaggaaaggggtgcaaagactccgaggcttcaggaggcaggccctgtcctcacagggcggctgtgggccggggcccctctgtggcctgagagtgagcaggagggaaacctgaagcagctacccgcaaggcgtccggtcaacagggtggagctgcaggctccctctgcccattcccagaaccagcggccccctttgtaagatgctgaacacgaagttccggtagctccccagacgctgtctcagaagtggtgatatcattgaccaagggcctggcaaggaccggcagccagggtccccatttgctcttgcagccctagggactgtgcaggtagaagccctgccagcagagcaggctggcgtttggtgttggcccacagacacccgtgaagggtcatggccgaatcaggcagctgtccagccaactgtctctccacccttccagaattggtgatcagcgaagaccaaattcggcaagccatccagagggagtgcagggcgcacagtcttagatgtgggcgcacctcccagaaccccacggggacttgttcacaggcgcgcttgcaggagggcaagccccttggtcctggaacacaggtgccccttggcctttccacctccctccttggggctgtttgcatccctgccaggagccttaaaccagccacctactgctgaagtctcttgtaacattccaaatctatgtgacacactgtataatgatgaatatttaatgtgaagctcttaatatactacaagtgtcttgttt

SEQ ID NO: 660 - DNA, 2244 bp, Homo sapiens
attacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaagatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgag

SEQ ID NO: 661 - DNA, 2649 bp, Homo sapiens
ccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaac

SEQ ID NO: 662 - DNA, 2174 bp, Homo sapiens
tgctgaggttaacaaagatgtaataattctcttcacacagccttgtactgttttattgactgtattatcacaaatcctgagcttaacgaaagtctttataagtcagctcatgaaaacaggcacgtggccagtaagaatttaatttcataccaataacacttcagacttcggatgtatttaaggctgtttgcacatatttatagaatgcgtggtgtagatgatgggacagctccccctcagcaagactctggcctaaatgtatttgctttatttacacaacaagaggataagcgtaaacacgggcactttcagtttgtggcactgaaggacgatctacacagggcaccctgcagaggccacaaccaaggccgcctggcttcccagtgggacaggcctaagggaggacttctggcccctttgcttgatgttcatgttttatgccttgatatttctttttggttgcattccctggagctcatgtagatcattttacttttcagaggtgctagttctggtgcccacacgcacacacacaaaaccatcaactcttctggattccttggttttaaagcttgcctcatacaaagtacagagacatctttttcaggaaacattgccaccacatgcttgaaggaccgcttatggctacacttagacatctccaaccaaggtctcttcacctccttctacaacaatgcactttgtctgcactgggacaaaaaatgacagccttttttcttttcttgtttttttttttttttggcgtggagcatttccgaactttcacgtcataaaaaatgcagcatagttaatcagcagcttgcacttctgagggcacattcacctcgggggaggaggaaggaggaggagctggtgggtgctgagactgcagtgtcctccttcccagcagctggacccatagaccaggcaccaaatttttttgatgaaattatcctaaggaaataatcaaatttgtacagaaatttatgttaaaaaatgttcatggcagcaccgtttaaaatggggagaaaattggaaacaacagaattgtagcaatacatatgatcattaaaaattatgttttagaaagatttttaacagtctttggaaaaagttggtgacatgttgctagtttttaaaaaaagtacagagtatgtacagtatgattccaattttgtgtttaaaaattagacatagtggtaacctagcttcagttccagataagatggagaaggcatactcctttcatgtctcccactgaatgcagctataaatcctggagagtagacagggagaaactatttgaggactctggaacaaagacatagtagcaatcgactggtgaagaagacaagaatttgaagtacggtcaagtatctgtgggctccacatctgtagatacaacctacatgtattgaaaatatcagaaaataaaaataacaatacaacaataaacatcaatacaaataacacaccaatacagtatagcagctacttacataacactgacattgtattaggtagaagtaatctagagatgatttaaagtctgtcggaggacgtgtgtagcctgtatgtaaaaaccacgttattttatatgggggactttagcatccaaggatttgaatatccacgggggtcctggaacaagttccccatagacaccaagaaacaactgtattcctgaaacagtcttgagttatcattttctttcttctccctctatgtatgtacatagagtgtacatacatagagtgagaagcaaagaaggtccatgaaatggaccaattcttttgaaaactgcaaattaccacagttcatctaacatgaaatagataacctgaatggtccaataactagtaaagatattgaattaatagtttaaaaaccttctgaaaggtaaatctctaccctaaatgatttcactggtgaattctatcaacacatttaatgaagaaaaaactccagttctaaacaactttcagaaaagaagagggaacacttcctcactcattatatgaggtaagcattgccctaataccaaaaccaatgttaacacaaaatatgaaacctacagaccaataaccctcatgaacataaatgtaaaaatcctcaagaaaacattagcaaatttaaaccagcaggatataaaaggaataataatacaccataac

SEQ ID NO: 663 - DNA, 1764 bp, Homo sapiens
atatgcacccaaagcactcttagttgcagccaaagcagtggaagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaatcctaatgactaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttg

SEQ ID NO: 664 - DNA, 1872 bp, Homo sapiens
gacgcatcccggaatccagagcgcccactacggcctttggcctggccccctgggcgcgttccgggagctcaggcctgtggcgctgggagaagcacgctggccaacaagtcgggtggtgggcacgcggcccaggggtcaggggccgctaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccggctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagccgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccagcccctcctactgggctgcagtccgggagctgctgcctggcctgaaagtcatcgacggtgagcgtgtgattgggcgtggtagtgagttctaccagctgtgccgagacctggacagctccttgcgtcccagctccagcccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccctcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccctgcagcaccttctctgcccgttcttgtccacacatctattaaatgcttctgttttc

SEQ ID NO: 665 - DNA, 1833 bp, Homo sapiens
aatcagcgagactccgtgggcgtaggaccctcggagccgggtgcgggatatagtctcgtggtgcgccgtttttcaagcccgtcagaaaagcgcagtattcgtgtgggagtgacccaattttccagatggagtctcgctttgttgcccaggctggagtgccttggcgcgatctcggctcactgcagcctccgcctccctggttcaaacaattcctgcctcagcctcctgagtagctgggactataggctcccgccaccgtgctgggataatttttgtattttttagtagagacggtgtttcaccatattggccaggctggtctcggacccttgaccttgtgatctgcctgcctcagcctctcaaagtgctgggattacagtagggacggggtttcaccgtgttagccaggatggtctcgatctcctgacgtcgtgatccagccacctcggcctcccaaaagagccacagaatctcacagctgtctcagaattcctcctcctgggactctcagaggatccagaactgcagcccatcctcgctgggctcttcctgtccatgtacctggtcacggtgctggggaacctgctcattatcctggccatcggctctgactcccacctcgacacccccatgtacttcttcctctccaacctgtccttgcctgacatcggtttcacctcggccacggtccccaagatgattgaggagatgcaatcgcatagcagagtcatctaccatggggactgcctgacacagatgtctttctttgtcctttttgcatgtaaggatgacatgatcctgactgtgatggcctatgactggtttgtggccatctgtcaccccctgaactacccaggcatcatgaatcctcacctctgtgtcttattagttttggtgccttttttccttagcctgttggattcccagctgcacaatttgattgtgttacaattcatctgcttcaagaatgtggaaatctctaattttttctgtgacccgtttcaacgtctcaaccttgcctgttctgacagtgacatcaataacatatacatatatttagatagtactatatttggttttcttcgcatttcagggatccttttgtgttactatacagttgtcttccccattctaagaattccatcctcagatgggaattataaagccttctccacctgaggctctcgcctggcagttgtttgcttattttatggaacaggcattggcgtgtacctgacttccgctgtgtcgtcatcccccaggaatgatgtggtggcgtcagtaatgtacgctgtggtggtcacccccatgctgaaccccttcatctgcagcctgagaaacagggacattcaaagtgccctgtggaggctgcacagcagaacagtctaatctcatgatctgttccatcctttttcttgtgtgcgttagaaagggcaagcacattaaatctctacatctgcaaatcctacccccttggtcacattatttttgttgcttgatggcttttattcctttccacatttcctatgtgaatattgtcttctttgttatgcctttaactggaatgatgagtattctgggatcctttgtttagcgtaaacatcacgactgaatcctctctacctaggtggcctcctttggtttctgagcaataaacctgttttccaggtgaaatcacaaccatcttttcatatacaggaagtcctgacttcattttgtgtttgcctgaaaattgactttatggaaacaatgtacagtaggtcctccaacaccactgttttgttcaaagttgtttacttataacgttgatgaggaataaattggtttcactat

SEQ ID NO: 666 - DNA, 2715 bp, Homo sapiens
attttgggtgggactaagcaaagacgaaacaccctcccagtctatggggtagtctggaccctggcttatctggttcccttaatcctttaggtacttacacgacgttgggtgaggggagctggaagatcagcgggtccccgatcctctctccctaggggtgatagaaatcaaccccccccgccacctccaggtggttcttcccgccgcagagtgggagcagcataaaaggcggggtcttattagcataatctgcctggcaacctgatctcgacgttatatgattggttaaactctgtaagccccatgccgtgcctagagacgagaaacgctggggcgaactgacaggcccagatttaggagtcatgacgaagatcctgagacgcttattcagtctgcagagaagccaaaaggagattcacataatggcccaatgactgaaggcctctttatttcgtgctctgctgttcgtgtaaaacccaatcgcagagcgggtctcaggcggcgctcgcctgcgtttctactctcagccaatcagaaaacccgactcttcgcattggggtcaagcccccgctgcggcccgcgtgctaacggggaggaagcttccagctgtgcctgggtgtctcgggcgccgagggcagcctgcgcccgtgctaagcccgcctcccgcgcgcccgagggcccggtgtcccggaagacgcgcgggggtgaggcggccctcgcgtccgcccgccccgccacagattgcctccgaagtggcctggccgtggagcgccggcgaaaaccgaactcccgcccggctcccggagtcgggagcctgccggggtctcgccctcaggacccccagggagcggccgggcgccgcctatcaccctgacccaccgcaccttgagagcgctttcactgcgcctcttttttctcctctaccaatctggaaaggaagtgagtgtcatttcagacattgagaaacattattcaacactggttacccagtgactcagctcactccttaaccgcaggcttccacatcctgctgtcccttaaaattgccttcacaaagggcagccaagagcccagctttggagagatacccagcttcaactacccactggcaggcaatacgcagggcagctagatggcagagagaccttggaccttcggaccttcggggagcggttttcccttcggtgatatctaccttgctatgttcgtgatatctaccttgctacgttattttgaagattaagtgagctcttactttaccgagtaaagtgctttgcttagcacactgtctggaacttaaatgagaagtactgacaatataacttacaaaaatcctaaactattgcctgagaaaaagagggagacaggacagctaagcaaaagacgagaatagaaaacacccacagcgtgaaaaactgtaaaattaactcaatagtattctctttactgttttttgttttgttttgttgttttgttttttgatacggagtctcgctctgttgcccaggctggagtgcagtggtgagatctgggctcattgcaacctctgcctcccgggttcaagcgattctcctgcctcagcctctctagtggctgagattacgggcatgcaccaccacgcccggctaatttttgtattttcagtagagatggggtttccccgtgttggccaggctggtctcgaactctaacgtcaagtgattctcacgcctgtaatcccagaattttgggaggccgaggcgggtggatcgcttgagcacaggcgttcgagaccagcctgggcaacatggtgagactctgtacaaaaaacaaaaagattagccaggcatggcagtgcacatctgtggttccagttaccggcaggctgtgcaggagggttgcttgagcccgggaagtcaaggctgcagtgagctgtgatcgtgccactgcactacaacctgggtgatagagcaagtctctgtctttaaaaaaacaaaacaacaacaagaagaaacttcagacagttaactgctttgtaaacaacttcacatctaggccgtgtcttgttcttccttaaaccgctgtacaggtggcactggacttagatgaggccgaccttaacatagctagtgagagacactagtagccctactctggcaacacagacatggaaatcagttgcctaaggaaagatcatattggctaagagagtcccttgaatgctcccttttagtgttacgagtagatgaacaatgccgcaggttggacaggtccttctgtgtccttgcaaaagctgccactccacatacccctggcctcagtaagaacggctcacttttagatttaacatcattacatccttgctgatgaactgagatggtcccaactgaggtccactgaccagaaacaacaccacagaacccaaaagagaacgcaccatggggaatggggctattcaaactgaagagcctgagttactctcatggctttagagaaatgttctaaaacttctaagtacataaatatgtgcagggagattcctccccacagagtttttattcagagggtctggagtgaacctcaggaatttgctttttatgtggatttttaaatgatttttaaagtttacactgtaaaattcactcactggggtatacaagaagtatttattgaatatgtactgtgtgccattcatttttctaaacaataaagatagaatagggaacaacagcaacc

SEQ ID NO: 667 - DNA, 3547 bp, Homo sapiens
tcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcacacctggtcctggcttgtggagggacttgcactggaggtattgctctggcttgcctggggaagtgtcacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctcttcccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctgggcttgacgggagaagagaccagcgacatggtcgttggggagcattcaggatggcgacttcagctgggggtcatgctgagcaccaacaggaactattccagtgaagagcaagtgctgcccgacccaggaccctgtgccaggctagcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagtcagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcgtcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactaaattattgctgggattccttataagcactaattatacctgattataggttaaaatatttattttgtcaaaatattttcttgggaatgtgtttaaccctttctgcgttcattgttgctgagatgtgaaaactaaccattccctcctgcctacctttttggccactgggcggcagagaatggcgctatgtgcagttgggcccccggcaccatgggcctttggcctgcctgctgcagagtagccctgcctgggcagtctccaggcactgagcaggccatctgtggccaggctgagagaatgactggctcgcttaccagcgtgcatgggacaaggagctttggagcctcaaggggttgttgctggcctgggctagagggaaaggtgaccatccgtctgtcctcctgtctttctattagcgcctccatgtgagtgatggtgccttggttcactagccttcccccaccaccccaccatgccacctggtggtcttggggcctgtgctgtcactccagcccctggggaggagaggacccagcccggagagttggggcaagggctccacatggcccaagggcaacagatgctcgcagggcagctgctgccgatgctcacgctcctgcccccctccttcccgctgccacaccccaccctgggcccccgcagacacgcatctctaactcagttgggcccagccttctggatagcttggggtaggccatgggcccacctggggccaggccagcccctggggcagctctggaagagcagtgtggaggagcacttgcttgcagcctggcttcagcctctggcactgctggagtggtccctgggagcttctgcactgtcggctgtggggacgtctcacccacttgggttacagtaggccttccccacccagagagaagtgtttccaccccagagacattgcctgtcagcccctgaagtgctcgcctcccccagtgcccgtcaccagcccttcctatctgtggggtccaagtcaggcttcccctgcggccaccagccatagggagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaac

SEQ ID NO: 668 - DNA, 2824 bp, Homo sapiens
acaccactgcactccagcctggatgacaaagcaggactctgcctctaaaaagaaaaaaaaaaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcacggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaatagtatattctacataaaaaattaaagatattaactaag

SEQ ID NO: 669 - DNA, 2392 bp, Homo sapiens
gaattgaattgcctggtggatccaggagcgggaaggcaccgcgaacggcagggaatcctggcctgcaccttagtgatctgaggcgtggtgtttctgctggatccggtttcatcgtgttgcgccgcccatcctgaatagttgtgatgttgttgcctggctgtgctgcaggttagcccacactaagcggtcccgggctgttgtgtgggcttgggcgtgtgaaaagagggagcagatttacggtgcggttgagaagtacggcgaccaaacggtaaagagggaggaacttgaagtctaaacaagcctgcgtctcttggttttctcaagtggcgtttcatctaagtagcggtctggcccagaccctgcttatcttcacgagatcagaggagaccggacgccttcggggtggtatggccttagacgccggtagtgcagcctgtctgccccaaaggcgcggctcagccacgcccgtccgactccatgcgccacctctaatccagtgccatggggatcttatcgggacccgggagccgctcgccggaggtctggctgggttgctctccgtgtctacgcccaagcaccgttgcccgccgccttgcgccttctgttggcctcttagagccttccgtgattgcttgcgcctaggccactcgctggacctccgcggcgccaccctgtttcctcgcgggagtgccagaggccttttcccctgcccaagctctgggatctccgggcagcctccattccgccgactctccaggccttccccggctccggagctccagagcttccatgactttgggccgctccggacttggtgtgctctgaggtgtcaacgcccagggcccacagtcctgggatcttctctggtcttttgccttgcggcggggggattgttttgtatcccttgctgcccctcttgcaagaccctctcttgcttcacccacccagagccgtttctttaaaatttcaaccatgttctgaactgcagctttacagttgaatattttctttcagaataatttgattctgaactcggtttttcttgacatacctgaattgtttcatgtgagccggcaatttcacatgcttttactttttcttttttttaaaatttttatttttgagacagagccacattataatctattacttctactagagatctgtttcttcctatttaatgaattattgcttttcatatagtctgaaatttgttttttctctctttctttctcttcctctctctctttctttctttctttctttctttctgacggattctcgctctgttggccaggctggagtgcagtgttcgatctcggctcaccgcaacctcctcttctgggttaaagccattctctcgcctcagcctcccgagtaccttgtactaaaggcgcgcaccaacctcgcctggctagtttttgtatttttagcagtgacatggtttctgcacgttggccagtcctgtctcaaactccagacctcgggtgatctgcctgcctcggcctcttaaaatactaggtttacaggtgtgagccactgtgcctaccagcttttactttttctaaaagccatgtattaccctgttcaaggtactagagtacctgtttacattcctctataatatggcaaacattactaattttgggcacacactcttcctttgtcttattgaattcaagtaccttttcgtcaggtttgacttccaggttctctaaatgtgctttctggaggctgaagcaatcatattgctggagatatttctttacctttttgataactggtctaagaaacaaagattttacattttatcaggataattatctgtggttcctgttgcttgtttttattaggtttttgattacttgacaaaacagcgcttaaaagggttaagggtttttaaaaaaattcatgtaactgtctgtatttcattttgaagtattttgattatcatcctggttaaataaatgactattaattcacagtgacatttgatgctgttttgataaagtgtttttaaccttttgatattttggcaagctttcccgggatcacatcctaaattgtcttttctttttttatcttgaattaacttgatgttccagagggccctgaaacttttcaaatgtttataaaagagacatattaaactaaatcaggctcatttgaagatgataaactgtatgaaaaacattgtcaaataagttacactagatcttctttcagttatattttatgggtgtgttattgatatgaatgttccaaaattgtgtaaaactcctagaaatctaagacgtcatcagttgtaattctgcttatgttgtttgacacaaaataaccagtttcttgtcaatttctggttataataaactttcatcagatttttaaccat

SEQ ID NO: 670 - DNA, 1858 bp, Homo sapiens
actatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaatacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcgtctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactct

SEQ ID NO: 671 - DNA, 2693 bp, Homo sapiens
cagcgtggtggtgcccaggtccgcctcagcaaggtgcccgcgcccaccttccaacccaaaaggccggcgcggaagggcagcataaaggcagcggccacctgcggatacccaagtggccttacaaggtggccaaggaggagaaacgggaggcggaggaggccgagaagaggcgccaggccaaggtgcaggagaagcgcccgccgccctggaagaagaggacgtgaaaaatggacatttctgatactgcccagccactacggcaccacaacccatgctcatagtctccagggatgtgtagaacggcaatggcaggacagcaaacaactggcgatttccccaggtcccacgctcttgcggaaaccggtcactcccagtctgacgttggagcatgtgaactaagagtgacatttttttctacttgcttctgtgaataaagtgttctacagtcagccagcactaaacaccagaaaggaggagggaacagcgtggagcaattcatctggaattacctcggtgtgcagaggctgtcccttggctccacttgggataaacattgtgaaacatcgtgggcctctttcttctcaagctcctcctgacagcctcctggcaacactagaggcctcaagactatggagatcagaattgcaatggctttgtcatctcagcattgaccactcctgagacccaaggttcctcctgggagcaggagacaaggagtttgtgatgttggatggaaaataggatatatgaatgcagaagggctgtgctggacccctcttttcgcttctctccctgctgtcagcagtgtctctggcatggaggcgaatctgttgtgggtgaaacagaagcccctggggtaggaccagaccccaggcctgaaaaggatgcaaagcctgctgtttcaggctgtcaggaagaatcgtgggtaccgagtgattatgatgaaatgcaacccagagaggaaatgaatgggccctcactaagaagtgggtctgacatgtctctggcagcccaccggcaagagcacgacatgccctgcagccccaccatccacactacatgatgtgggagggctgtctgttcattcttacactggggacccaagcctgctctgaggagtgagtcacagccctgacgtgcgccttgcattactgtttcctgagatgtgcccggagactcaagcttgctcatctctgtcctgacacagctcactgttccttaggtggtcatagtcctcccgtgctgtgtcagctcctacatagcattagtctttcacgtgataaagtgcaagcacttttccattttacagtatttggggaaattctaacacactccccagggatttgtgcatgtccttctgcctccccggtgggtcattctgtggattccgcacctggcagtcggtcttcccccttggaagcccctaggatccctgtttctacgggcctggtccttggtttctaccccagtcccttttggccggcacctgcctggaactgcctggagcgccatggtatggggaaggacaggtggaaccctgaccacaacagatccttctaaaacaacagtcacattgatgatgatgagtgcagtggggtgaatgtcgtcacagcatgcatgctgggagctgccaagggcttacaacaaaagcagttcttcctaaggcaccctttgcatcttcccatccacgcctctcagtgcatttggaacttgcttatgcattggaataacttgagtcagctgctcgtttctgtgcctctgcactcacaggttccttcattaacattttaaataagtggttaaaaactcctctggaggttgtttttgaaagaaacagggaaaagaaaaacacacactacctgaattgatttgagtaattttccagtgactcagttgaaactcagtgttgcatacataatttcctcatgctgagccagcctgaaataagacttgataagaggcacagccctaagtagcaggcagtgccactgtggacagtgtacactatggtgtgagtgtgtgcacaggcgagcctaagtgtgtgtactcatacacacagataaaccgaaaggacactgggctttgtgctggcaaaggctgtgatgctgctgtggctttctatgggccctggggagtgtcagatgggaagtgctttgatggcatgttgttcagtgtatttaatggggtctcccatggcccgaggacccactgtgagcactccacccactgtggcgcagaacacggctggagtcatcatagcccaggtctttattgaaagggagtgttgacccagaagcctcatatagaaaccatttggcaaggtctggaccatctctctgcaactgacctgccttggccgcacagagggacccaaacccaaaaggcccagacccaagggagactgaatcacatttaccattacaccagctttcatttatttgtttccatatgatcatagggactgtattactaagtatgcttataaatgctatttacagactgttcccttttataaggtgaaagattaataaagaacaaaaaattgcctatagaaaaccatgcctgaggccaggagcagtggctcatgcctgtaatcccagcactttgggagaccaagacaagcagatcacccaaggtcaggagttcaagaccagcctggccaacttggagaaaccccagctctacaaaaatac

SEQ ID NO: 672 - DNA, 1839 bp, Homo sapiens
atgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagtcatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaacatc

SEQ ID NO: 673 - DNA, 2102 bp, Homo sapiens
tacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggtgggtttgctgagttctctcgttgtttccctggcctctgtgaaggaaaatccactctagtccctacctgcatttctcagccttgcttacctgttgccaacattgggccaaccctaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagactgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcac

SEQ ID NO: 674 - DNA, 2693 bp, Homo sapiens
cacggaagatgtaaaaattgtaataaaaacagaagtccaggaagagtaggtggtggccacacccgtacatcctactgacctagaggctcacgggaccctgtttggaccaggccaagccacacggttcttccctagtcctgcccaggaaggagcctgggaaagccagggcagctccttccccagccaggaccctgtgctggggctgcgagagcccgcccggcctgagagggacatgggtgagctcagtcctgctgtggcccaggaggagacccctcctggggactggctcttcggaggggtccggtggggctggaatttccggtgtaaaccgccagtgggcctgaacccgaggacggggcccgaggggcttccttactcctccccggacaacggagaggccatcttggaccccagccaggccccaaggccattcaacgaaccctgtaaataccctggccggaccaaaggctttggccacaagccagggctgaagaagcaccccgcggcgccccccgggggccggcccttcacctgcgccacgtgtgggaagagcttccagctgcaagtcagcctgagcgcgcaccagcgcagctgtggggcgcccgacgggtcgggcccgggcacaggcggtggcggcagcggcagtggcggcggcggtggcggcagcggtgggggcagcgcacgggatggcagcgcccttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccgtctgcggcaaaagcttcatccgcaaggaccacctccgcaagcaccagcgcaaccatgcagcgggcgccaagaccccggcctgaggccagccactcccgacgccgcccgcacctcctgatcccttcaagagccccgcctccaaaggacctttggcctccacagaccttgtgaccgactggacttgtggcctcagcgtcctgggacccaccgatggcggggacatgtgagcgcctccagccccatagcccctgccggccgcacgtgtaaaaagccccgtgtgcaggcagcagggcggcgtggaagcttcaggcagacgcgggacggggagaaccaaatgtccaagttgctgaactgatgatcactggagaaagagaaactatccaccaggacagctgccacctctaaaccaagtagaattctctgtgaaatgggagcgccgtagaattttaagtaatttaattgcaaacctgttttgttttttgttttttgtttttttttaattcttgaggaaaaagctggaaaatagtaatagggctatttaaattttgtaggtacttttggttttcagggcgtgcatttctgtcactatctcactgagtctgatagtgtgttggaaggttggccagttggggacccctggcccactgactcctggggatggggtcctgtgtgtgcccctgctctgcccagttgggctgagtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatatgtgcactctcagagggcacagctcacgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcagacggagggacctgacagtgcccattcattcagccccctcatgcatacttttattaggcgatagactagttaagaaaattgtttctatgtactgtatattttgtacctgtttacacttctaatattgatataactgatattttgaaaaataagagaaaacatcctgttaaaataaaacctaaccagcacc

SEQ ID NO: 675 - DNA, 3199 bp, Homo sapiens
cgttcgtttgggtgatttccctcggcggtggaggtcgctcctaatagaggcggcggcggatcacccgaacagccttcaggtgcttccctgctgacctctttttaacgtgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatggtgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactctgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggagcttgcagtgagctgagatggcgccactgcactccagcctaggcaacagagcaagactccgtctc

SEQ ID NO: 676 - DNA, 2256 bp, Homo sapiens
agagtgctagctccccggcggtggctgcgggtccggagcctggggacgtcggccccacagacggagagcgcgcgggagcgagctcaaggcggcgcggcggccactgggcgcagcacccaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatcc

SEQ ID NO: 677 - DNA, 1787 bp, Homo sapiens
tgcagttggctttcctttaaccttttagtctttcagagtaattttctttctttttttttttgagactcccaacaagtttattattttttaaattgtggtaaaatgcttataaggaaacttgccatcttaactatttttaagtgtacagttcagtggcattaagtacattcacattgttgtgcagccatcactataatctatctccagaactctcttcatattccaaactgaaactctgtacccatttaacagtaactccccattccaggctccccacagtctctggcaaccactattctactttcaggataattttcattggttagtaatgtttggataatttgattagatttggtggatactgaagactggccgggttatgtaagctgttgctactttcagccaaggagtgcatctagtccgtattacatcatccttggagtgttctacccagtgtcttgcattgaaggacatcagaaggaaaactcctgtattctcagtcgtggctttaatttgtgcctggtgctgacctgatgctgtgcagggacactcactgcatccctccattcagtccctctaattatcccaacttcctggggagcttgcttagaactgggcatgagtgctctttattaaaatattgggctaccctggctacatgtaacaaggttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcttcttttattatgagcattaaaggaccatccatgggagactatgaggattgttaggatgaggcaaagacatcttaacagagtttacaaagagctttgaaacgtgaaactaccttctctggaaaaatgggatgttggcttgaagatatttcttagtattctgtgttttctttctggtttttctatgttgttttaatcatattatcataccttgtcatttcaggtaacatagcataagttatagtaattagtttcaagagaaacatatgttagaatttgtgttttgtgtttggatcctatctgtacttgaaagatacacgtatatgtagatggatagtgagttccatcaggatgctcagcgttgaaagcataggagggaactgtgctgagcgtgtgaggtttggcgattgtgctcttttatcttctttctttcttgagtttttagcaagataagacatgtaactactgtaaaatgagaggtaatttttaaaatagccactgggttaaccaaaaaccttttaaatagctgtggcatccagtgtgggcaagggtcacctagttttgttcctggaagtgtaaattgtttcagacctcccccggcccccagaaatttgctagtatttatcaaaatttaaaacatctatatgttctttaatttaacagttccacccttaagaatctcacttacaaagatatacttgagaaaatgttcatggtaaggtgtttcataatagcaaaatttagaaagtgttcaaaagtaaaatgtggagaatggtggcttccctgcagggtcattggtcctcagttacaaggctgcagtccatgatgtgttatagtttaaagtgtgttgtaagcactttgtaactaatactaaaattctgaagttagcaagtttgccagtgactttgtttaacaatttttttgtttataaaataaagtggattaaaaatg

SEQ ID NO: 678 - DNA, 2832 bp, Homo sapiens
cttccgcttcctgtaccaccctgctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagccttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttctctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttg

SEQ ID NO: 679 - DNA, 2946 bp, Homo sapiens
aatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgatt

SEQ ID NO: 680 - DNA, 1876 bp, Homo sapiens
attttgcctcctgccttgaatgaggatccgatggaagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcatctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacac

SEQ ID NO: 681 - DNA, 2295 bp, Homo sapiens
cagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagcctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcgccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggagattggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagccgacagagagctgccaggccacaccccctcggcctcctgcacggccaccttctgggtgaatcggtccagcccaagcccctctccccagcctccccttcagcctctctcccggcctgcttttataaggcgcacttcactcaatgctgcagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttcctt

SEQ ID NO: 682 - DNA, 1987 bp, Homo sapiens
gaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgcttttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcaggtgaggaccagcaagtgttttcacaaatgtgtttgactcaagttaccgtcgaatgatgcattcacctctctctgtctgaattccgcaacttcaagtccttgtaaatttccgacccgacacaaactagcatggtggcaagaataccacatctagatacatgagagcagctaaacagagctatgctgtttgcagttccactgctgtatggcctgggaaaattcacctagcccctctgagctttagtacgtgtgttggttatggggcatacacttctgcctacttttctaggtccgtgtgagattatacaggtggaagaacttattgacttaacacaacaatgttcctggagctgtccctttgtgtctttcaaacactggggccaggacatacagttctggggtggccattatggagcctgtgtgaccaactccagggtggtcatgtgagtccatctgtcctaatcaaggactacccttctggcaagacagcctaaccatgccttccaggacctgggattattggctgggacccctcattaactaagtgcttgtacctccctggcacgctgggaactcctgggtctggtcaaaggtctttctgggcctgtcttcagggtctggaaactactagaagaaagttcttccatccgatctgcctacagctgctgctttgcactgtacaaatccatgttgttacctctcacctctggaattcaggtccctccacctttggctccttgagaaatctctattccatttctagctccattctgcattttctattcctactgtcagatgggactgcaatttcctggccatttgagcaccagacaagatctacgcttatcaaaattgccaagccagcaaagcctatgattagaagtaggtaaatttttttaggactccctctccatttcttggagcactgtgcgtcttctccctttttcttgtaaaatctcctctttgctcttcagtaccataggtcaaaatgtgcttttaaaggtctttgtcatttcacatggtctaagcttaattaaagcagtgattttcaaac

SEQ ID NO: 683 - DNA, 2058 bp, Homo sapiens
ttgaattctaagagttctaacagggattttattcatcttaactattttgacagatttaaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagagaggttaaggaaagctggatatgttcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccatgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacttagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcggcaattccctactggtatgtatcaggatagaggtgaatcaagctgatattttgcaacttctcagttttattttaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttct

SEQ ID NO: 684 - DNA, 2168 bp, Homo sapiens
gcagcagttgagtccatgtaagatgattgtgcacgtgtgtgtgtgtgtgtgtgtgtgtgtgtcctcactcacttaaaaaagaccatttctgtgcattctttatgctggaaccctcctctgcctccctctccaggaaatcccataggatcccatacctgctttagaatgtgtgtgagacacttcccagtgcctggcatgtggtaggagctcagtacatgtaaactgttttcctttgaccactcaaagtagtcacttgttggggaggccaatggcggcttccccggtctctgagctgatgggcgtctggtccctgcctccccttccttcactggctgatgacaaatacctgaatgtcatcacatcctccgtgtcctcatctgttattctggaacacaggccagggagggtacagggtagtcccccttcaacagaggctggcctttcttgggatgtgggctggctggtgttggtccaaggatggatgcagagggtgaggcacccatcctgctagtccggccggatgctggcaggagggcggggtgaggaggggcggagcttccagaacaaaggagaatggggagcccaggggccagcctaggcatcaaaaaggctctgcagagtgaacaggccacagcactgcctgcctctgccccagcagtcagccagccgaccgcgcctgctccctcctgcttgcccaaggccgggcaagtcatccccgctctgcttcgagaggccccgttttccagcgtgattgcgccgacactgctctgtgggtttctcttcttggcgtgggttgctgctgaggttccagaggagagcagcaggatggccgggagcggagccaggagtgaggaaggccgccggcagcatgccttcgtcccggaaccttttgatggggccaatgtcgtcccaaacctctggctgcacagctttgaagtcatcaatgacctcaaccattgggaccatatcaccaagctaaggttcctgaaagagtccctcagaggagaggccctgggtgtctacaataggctcagtccccaggaccagggagactatgggactgtgaaagaggccctcctgaaggcctttggggtccctggggctgcccccagccacctgcccaaagagatcgtctttgccaacagcatgggtaagggctactatctcaaggggaagattggcaaagtgcccgtgaggttcctggtggactctggggcccaggtctctgtggtccacccaaacttgtgggaggaggtcactgatggcgatctggacaccctgcagccctttgagaatgtggtaaaggtggccaatggtgctgaaatgaagatcctgggtgtctgggatacagcggtgtccctaggcaagctgaagctgaaggcacagttcctagtggccaatgcgagtgccgaggaagccatcattggcactgatgtgctccaggaccacaatgctatcctggactttgagcaccgcacatgcaccctgaaagggaagaagtttcgccttctgcctgtgggagggtccctggaagatgagtttgacctggagctcatagaggaggacccctcctcagaagaagggcggcaggagctatcccactgagaagccaccttttctttaacctcctaaatattggtgggaagacccaccgctgtggggggggttgcatatcctcatgggggtcactgggcttggccagtctgcttatcaactcttgctcttctctcccctttgcctccctctgcaggggccttaatctgcccctggtaggggaggcttccactgaacaggcacaggtgagggagagcaggctggcttagagggacagggtccccatggtcatcaagctgctgttgatgacaaagactcaaaggctggaagagctcccaaggaagctagaaatgcttgtctttgaaagaactgtgggaccccttcagattccctgaggtatggcttggtcactctcaggtcctcaaagcctgtcttagttgggctgggtcctagctgcagggtctttgtgagggtcacagttgctctgggacacctccctgaagagcctttccacctgtacaatcgtattttctttctgtcatttgctttgaagcccattgtgccttatgccaataattcaattgctgcaaacaccaataaagattgattcatgg

SEQ ID NO: 685 - DNA, 2341 bp, Homo sapiens
agtctaaagcctggctcccttccggcctggcgcgctacggttcccgcaggcgctccgcttcagcaccgcgggcgtggacagctccggggcgcgaggctctgggactcatctgcaggaagtgaacctggcaggaggcttgcttcaggtttttaggaaccatttttgcaattggagatgtttgtgaggaaaaaaatctctgttgaggggggtactgtgtgtctctgaagtggcctctgtgttgcgtctcaggcgtcctggtcctgtcctggtacccacctggcatggctgatgataacggggagccctcagatgacctggtgcccgccattctggacaccgcccatcagtacagcatccaggtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaagtaagcattccttttgctctctttaagacctcacagattctgaccttagattctgtgacaaactgatacaggagctgggctggctatggctttaccacaacaagtaggtttgcttaagaaattactaaacaatggctgggcgtggtggctcactcctgtaatcccagcactttgggaggccgagatgggcggatcacgaggtcaggagatcgagaccatcctggctaacagggtgaaaccacgtctctactaaaaatacaaaaaaattagccaggcgtagtggtgggcgcctgtagtcccagctacttgggaggctgaggcaggagaatggcgtgaacccgggaggcggagcttgcagtgagccgagatcacgccactgcactccagcctgggcgacagagcgagactccgtctc

SEQ ID NO: 686 - DNA, 2954 bp, Homo sapiens
gctaatttaaccagctcccacttaaatcaagaaataaccattattctcgtttctacctccagccaggccaaatgcaagaaaggagaaaccttagcatttgtggggtgtaggagtgtgtgtatatgcatgtgtgtgtgcctgcatatgtgtgtgtgtgtgtgtctatacacacacaggagcgtgtgtttcctctgctccatctctcctctcccttccttaaagaattcagcctgtggccactagaggtcttttcttttcacatggtagctgccgagcagtttgttcggctttttatttattcctacgtgagcagacccactacacttcttgcatataaacagtgaaaattacaatatgaaggacttattattccttcttttggagtaattttgctgctggtcaaagcctggctcattgtgcaaggaagggggaccatcctctgcaggtaattccactgcttcaaggtgctcctcgcctgcttgcagatatcagaccccagctcatctcagacctcagcccctgaggccaagcaaacatacatcatcatggaggctgcagacgtagctcaccgtgcccacatgtgaacttcggccaacacaccacaacagggactctgcccactgaatcccctgtgattcctcaatcctgtcctggtcataccccactgggttttgtgaggctatttaggaagataagcttccctcactgaagaaaagagagacagcatgaaagaaaacaatggccccaaaggaggaacttgtgattgacataaatgggaatgttcccttgggagcatcatgtatcatcaaacaagcaaacctccaggtcatttatttctccacctgtttacctgctatggaaagaagatgcatttaagtttcctgcagtttcaccctggaaattaatgctctgggaaacaaaaagctgtatgttctagacgtagcaggtttcttttggaattcactcattgggagtctggcactaccccctaaatggtacttttgttgtctttttgttcaagacagccagcttcttccaagatcagaaccgcgtgccagcctcccttgataaaccgcctaccagctctcttggtagatcagatgtttaatagttagcctaactcatttgtttttccaaggagcaattatgactacaatgaattaatattttaactgcagggaaagcattacagatagttcctacgtagactctagaggctgggaatggccaacaggatttcccatactaagaggagaggaccactccatcctggccagcagttctctatgattgaaatactatcattagatactgctccaaagacctaaggggagatgtgcctaggagaagtgtatggtcctgatccttcccactgaggctcaatggcccagcaaaatatgaaagtgagacctgtgcttctaaagcgtaacagtctagaatcagtggagtttgtgaaacaacctcaccaccgcaggagcaaatcccagcaggtgagattcaaggaagatgggaccactaagaatccaactggcctagctgaggttgacgtccaaactccagaagacccggctgtgatggggaagactcaagcaaccaggcaccatcttccccccacctactcgctctccttccccaggtcccagaaggcagggggctttcgcaacattgcaatccaaacttcccccagtctcaggaagcatttcccagttttcaaaaggaagagactcacagccagtaagtccctggtggaaatgccaacagcctcccaaagtgccatccaggtcaacggtaacctctctgaacaggacattgtgtcttctgaccttgcctacttaaggttggctcagcatcttgaggatgggcctcgaagggtcaaggtgtcccatgcattcctcccaagggtccccaaggtgcaaagcaatggtcctgttagcatatgcttggaagcaggaacttggaggtccttagagaaagccacagctgccattcaggttccagatgatatttatcacagtccttcctgggaagctagagagtctgctctcagcccagacaggtcagctgaagtaaggaactccatacaccctttggatgacacacgtccaggtgatgggagaagggtgactccactagattcagaaaaatccacctcctgcttaaatgccaccagcgttgccagccacacaccaggcacagaggaacttaaacctgaattgcttttgcccaaagacaactcagatgacaaagaccttggctcactgtcatctcagtcaaaggaaacgtgtgttccttcatctccacggactcacagttccccctcacaaggctcccacagccagccagcccacccaggaagagcctcagactgtccttcatcaagtaacaatcaccagaatctggtgtcactcaaaactaacagtgcatcgaaatctgcccctgggtgtcaggagcagacggcaaacaaccccaccgagtcagacacactggagtttccaaattgtccaggaagtaatcatctcccatcctctctttcaaggagtgagaccaaacttcagagcaacagggagattagtgacattaatcaaattcacctggcacggggtgaactctgcgacctccaaggccgactgcaatctgtggaggaatctctgcactcgaaccaagagaaaattaaagtccttttgaatgtaattcaagacttggagaaagctcgagctctcactgaagggcgcaacttttatcgaactggccaagatctcaacaattgcagtacctgccagaacacggcgtgcatcatatacagtgtagagtatgattttcggcagcaggaaggcaggttccatgaagttttgcagagtctggaggaagcagagccagttgaggaggcatcgcccccaccaaagtccccagcagaacccccagccccggaaaagcaggacttaaggcggaaaacc

SEQ ID NO: 687 - DNA, 2406 bp, Homo sapiens
tatcgctacactgccgcggcgagtaccgggttggcggcgctatcctgggctacaccgccggtggcgggaggcgttttaggggcgctatctggtgctgcactgcccgcgcaggagttgggttgggtgacctactccaggcgtcactgcccgaggctgggggctgatttggggcgctatcccgggagtcatttcctgtggcgaggggctggttgagggtggtatccgtggctgcactgcccacagcacagagcgggtttggggagttatcccgggctgcgctgcccgtggcagggggcaggctgccagcgccattgggtgctgcatgtactaggcacggatgagttaggggcgccatctgggactgcactgccggtggcgggcggtggaggtgtcagtgacagcggtggtctgcaagagaggagcggtcctcctcttcccggccacctcctcctgttcttgctcaagtgcggcgggcgcacagcatttcctgagcgcggcaggggccccagccccgtggtgcttcctggacccgcctcctattgctctgtgttgcagagaccgcctgggaccccggggcacgcagtagtggacacgaggaggctacagggccctgtgggtggaggaggcatcaggaacgggaaccggcacttgggtggggagggctggctggggttgagtttctgctgctcctgcttcccgaggagtgcagccagggtggctgcagctgttcctgtggagtgggaagcccgggcactgtggtgtctgcagtccccactccaggccgcagttcctggccagcttgcgctaaaaggagaggctggactttgaagtgtgggtgcttttctggctttgtctgcccggatgcccagtgccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagcctcatcaggttagagggtgtggaagggcgtgacccagtgggaggtgggaatctcaccaataaaaggccctcgtgtgccccttccccacaagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctcccggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatc

SEQ ID NO: 688 - DNA, 2052 bp, Homo sapiens
tctaagcactgaagtcggtgtttggagaaaaggactcaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtttgcaaagatacataattacagagactgaaagactgggctgtagtgaggaaggacctgctgatgaatattacatcatataccgaaatgtttttgataagctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattatctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgtagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatgacatttagatttgtctttgaaatatttatactattgcttccttttccccatatggtcatttcttatattgaatcttgataaaatccaagattataactttgtgtgaaacagtgtagggcatttttatctaaggacataagctaatgtccagatatattactttctggtgatgtaatatgatagcaagaactgaggaaggtgtgggtagtatcctgtgtgttagactgtcttcccaaacatgaaatgctacaagcctgacttgaccagaaaagcaggaaatcatttcaaggttggacttgctggcaaaaacctagagtatagtaattttgtactgctgatttaaagatgcgccccatgctttgatatatataaatatggcaaagcttaggcttctagtataaaagctgggactcttggcatgttattacttagagagaagaccagtcgaattttgcatagaagtagacctgtgatacctataggtatggaaaatatgtcataagaagtggtttttgattatttcaagtgtctgaataagtatttgattgaaaactctgaaaattctgtgccatggacaggtgtaatattaaaaatatttaatgattagtatggcatgggcacaaatcaagcagaacagatacctaattaatcagaacagcctttagcccttatgccacaccagagcttactagctaaatgtcatccttgaccatggaacatggttaaaatgagctgctggctgggcaaggtagctcatgtctgtaatcccagcactttgggaggtcgaggcaggaggatcgcttgagcccaggagtttgagaccagctaggtaacacagtgagatcccgtctctgttatt

SEQ ID NO: 689 - DNA, 2345 bp, Homo sapiens
tagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagttccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctttgcaatggagcacgactcctcggcgtgcaggactcagacctggacatattatgccttggacataagtttggtggggaggcggttttcctatttattctgtgagttactggatgtccagctaggccaggggcctaacctgggcactgtgccagggcactgcctgccccccaccccaggaactggactaagccctgctgaggggcaatgtggcgacccgggaggccgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacacgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctct

SEQ ID NO: 690 - DNA, 2311 bp, Homo sapiens
gagcatccgcgacacccccgggagacccaccccagctgctgctgccacactcgcgggcgctgcccggtaatggcctgggggagtcccgagtccgacgcgccgctggcctcagcctggacgcggacccctccgcgagcgcgtctgtgacccacggaaccggcaggcgctctctgcttgtggcgcccagagggcggcgctgacacgggcgcgatccgggaggcgaggcagggcagggcactttcgtcccggggcgatcccaagagacgccggctctgggaccctcgccgggtcctcgtcccgcagcctcttctcggcctcccgcgatcctgcctgcgccctctgcccaggactcgtctctcacgtcggctccccgccagtctcgggagcctccgcttccctcggctcccgctagcccctcccgggacctctccccctccaccccctcccccaccccggaggccgggctggacgcgacccagagcctccgccacccgcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacggcgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagaggaagaagagaaggagatgcccagccccgccacaccctccagtcactgtgagcgccccgaaagcccctgtgctggtctccttgggggggacgggccacttgtggagcccctcgacatgcccgacattaccctgctgcaactggagggcgaggcctccctgtgaggggactccgtggggcactaccttcccgggctgtctttgggtttccgagtgcatgacgcgagggggactgaacggcgcggtgcggcatgcttcactcggacagctgctcttgtgggtcaggcagagagagactccctcgaggaaggatttgtagggtgaaggactttgggagcatcgagaattctttctgcccaactaagcgaattatagcgaactgcggaaaggtgaggctccgggagaggaagcgcccatctctggactcccatccatccctatcctgtcctttcccccttcccagacaacaggagaacccgtgaattgtgtaaataaaattctgctttttctattctgaaaaaggacttacctaggaccatggcaaataatctctaacaatttacctggaaattaaggaattgggggtattttgttctggcaacaggaaatttacccttctgctgaaatccaagatattcagtgctctgcagaagcctctccccctcacagatctctgcggctgctgattggtaaaggaagcttgaggagggaactgcagccctaggaatctgggtgaatggggttccaagggcccctgggctgggaggagctggctatgaatgtgcatgaagacataatagctcaacctctaggattttgcatgcagagcggatcctgccttgtcactgacttcatctgggattgcttttccactccctggggcttagagaacaaagagcccggttcacaggcagagactcgggggtgctcagcagcagcccagatttaggggacatttgagggactcttggggccgcagccaaaaactgtctctcctggctacacctgcttaacttcagttcctttttctgtcaatatgtccttgcccactgcctctcggtgttgccttcataatgtcttgtgtgtgttatgtgtgtctacttgtgtagtagtgtgtgagccctcaggggcagggcttgtggctctggtgttaggttcaggggcttcagacccttctacgagctccaagctatcaatggcgcttttctctccctcttcccccaaccagggcatggagcatgtggctgtcctgaggttcttttactgatgtgccgcccttccacctcctcaagtggtgactttgtgtgccctccccctcctttgtgtattccttctcaatgctttccttggtgttaaccttaataaaaaggcgtcatctcccctc

SEQ ID NO: 691 - DNA, 2314 bp, Homo sapiens
agcatgcagttcggtcacctgagggtgctggggccgtggtttgagcttcatgggctcaggtccatggccgttgagtgtggcgaaactgaggcacgctgtgcgggggacggggggcgctcacagaaggtagggggcctcctgtgccttcatccaggcactgcccggcctttcccaccctgttgctaaagcaggtgatgacagaggtgatttgatcagcccagacccgtgcggcacgtggagccttcgtccgtgggagaccacactgccgaggggcaggccagagccgaggggcccctgacgcttctctgagtgaccctgaagtcggtgctgcttcagccctgctgcactgggcttgcatacgtgggggagcagggagccatacgtagtttctgctgaatgtgggagtcaccaggacgtcaatgcccacctctcaccttcgccacccctgcctccctaagtgtgtgctccaggaggttgcacggcccctggagaggttttcggtggtgggcttgttgcgtctctggcttccagagacagcaggaatgagagccaggccagctcagtggagtccatcccggtgggtgccacggcttttgcaggaatggaagccccgcccccaggagggccactgctggcgaggcttgagctctttctgtgacccgatccccctggtcacacgctttgctaaggcgggtagcctagagctggaagcccctcctgccacccagccactgtgcctctcccagctgatggacgaggaagcctccattacttgatttttatttttatttatttttgagacagggtctcattctgtcacccaggctggagtaccgtggcacgatcatagcttattgcagcctcggcctcccagtctcaagcgatcctcctgcctctgcctccagagaagtagggaccacagatgcgtgctaccacgcccagctaatttttgtatttgtattttttggtagagatgggggtgtcactatgttgtccaggctggtctctaactcttgggctcaagtgttcctcccgcctcggcctcccaaagtgctggattacaggcgtgagccaccacacctggctgcatccgtcatgttaagaagaccccggctggcaagctcactcggggactgcagggaaccctgccctttgggggcagtagtgaggggtgcccaggaggatggggtggtcagcaggcagtgatgctgctgtgtcctgtctcagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgttggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtc

SEQ ID NO: 692 - DNA, 2114 bp, Homo sapiens
tttttgtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacatagaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgtgccattctactccagcctgggccacaaggcaagactctgtctc

SEQ ID NO: 693 - DNA, 2418 bp, Homo sapiens
agacgcatcgactgctctccttgtgcccctgctgacattcccaagagatcaatatcctgtaaaagcctgaagattgcttcctttaaatgagtcttattcggaaaaacttaagatttgatcatagatctattttaagaagtgccaagttaactgacatcgatgccatcgtatctggagtccctaggaaatccagggggggacaatgaaccgtaggaagactcggactcgggtctgcctgtagcactcggagcctgcaaggcaacacagttattgagttctattaaaattacttggtgtggctataaaccaaaccacacccctgtagccaatgcgaagagcttcccgtaaaagccgtgcggtgggaaggcctctcgctgtctcctctgcgcggcaggcagacatggacgacaccgaggcgtgaattcagcctgcacctcctaaagatgagctgttgagggcgatggccacagcaagtccgcaccaagtgctctttaaacatgagtgtttctttaaacaaagaaccttcccggcattgaggtctgattaatgatgccccggcacctcctccctcactcagggatcacttccctgcggcgcgttcccagacgcaggcttccctcacggaggcgggaagatttcaggcgctttctgttcttgtcttttgtcagcacggacaaggatggagaccccactggtcaggcgagccccgcggtccctgttcctcacttcaccacctggggaagcctgatccccatcgattcgcaaaggaacaaggaaagaacacgttttacctggatggatggtccccctcacggtggccttggaacccgcttcagcgggagaggcagcgcctcactcacggctccccctggccgctgctttaccagggagcgccaccccgtgccccgccagaggaagtgcaggcgccagcacagcacgggccgaaagccacactgtgggacccgcagcgcagctccaagaaatccaaagtccattcacaagaggagcttctccgccaaatcgttgaaaaataaaacgagaaatgagtcgccaccggtatccgctttagtcagccgtacgaaaacgcaacccggtcagctgcacttctgctgccagccctcctccagtcaagcaccggcctcgagaagggcaaagggcaggtaggagttccgacgcatgcggccacggggcggagtcacagttcagaggcctcagctgaacctgaagttatcctaagctcgagccccagagtgaggactcggggtcaggcatccgattccccatcagctcctttactaaagctgtgcagagaatccgaggctatgagtgggggtgggggaaagatgtacaggatgctttggtttcactcctgagatacgagaacgtcctctgaacacacatgcagatagctggacttctagacagaggaaatccaaatcgtttctttcctcccagcataagggaacggtccggtaagagctggtgtttatcgatgctacgtgccagaatggggctgagcacggcgcctcactgtatcctaacgtctaatgaggcagggaatgtcactgtcacactctgcagacgaggaagccatgctgtcagcaggtacacatcttgccacaaaaccagtaacctgtggcactgagatcgcacaccggtcgtccactgccaagtccgtggcctccttctctggggtttgcctgcctcttgatggcggccatgcctctgtcctctcgcaggggctggctcttccagtggtcactactttttggttgcaagcagcagagattccctggagggcttgttgaaagcactcacatcaacggagcctcagaaagggagctgaggccatgcacggccctgcagtttctcctcaggctttggtttgcatccctggcctgactttccctcaacaagtcctgctatctccacaaggcggccagcccagccctgtcctcaccttccagccccagctgagcagcccctccccacatcatcttcagctgctgcccaggctccgcagagcaggtgtccaccgcccatccagccattgtgtttagagggcagagcgacctgccgggaccttgacaacacctggccccacccacacgtcctgcaatattcactgaggaatgcacagcagcacatatgtgcctcatgtgtcctgctgtgatgcagcgagtggcacacagcattattgtgtcaatcatgtgtcttgatgtgatgcactggttcagacagtatcatggatgcagtgtttctttaaaactgtcaaatttgaggaaacaatctaacaaaagccaattgatgaacattctgtaaaggtgacataaatacttcaaaaatgtctctgacacagaaagaaaaaaaacaaaaagggagctattccagattttaaaaataaaagatatagtaact

SEQ ID NO: 694 - DNA, 1828 bp, Homo sapiens
ggggatccgatgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaattatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagctgggcatggtggtgcgtgcctgtagtctcagctactcaggaggctgaggcaggagaatcgcctgaacccgggcggtggaggttgtagtgagccaagatccagcctgggcgacagagccagactcttgtctcgagggg

SEQ ID NO: 695 - DNA, 1785 bp, Homo sapiens
actcagctctctcaccatgcgattgccctgcaacaccttggaactctgcagagagtccccagcaggaaggtctcacctgaggtgaaccttcgaccttggacttctcagcctccagaatgaagaatggcaaccatcaaatcaagaaattggcccaaagccctacagtctgcaaacatcataacaattcatcctgaagtttctccatgaattgtgatgctttgctacatcattctgcaatcccagaagattttttgcatatttttttgctattacagaaaatctcagtctccctccctctctctctctctcaatctgtgtgtctcttttactccatatctctgtgtgtgtctcttttactccatatctctctgtgtgtgtctgtttatgtctctctctctctctcatccttcccatgtttctctctcacacacacacacactcattcacagctttcaaaagacacgtctgtccttaccttcactttttgttttaaacagcacactcactttactctgaactatacctcacatgcacacgagctttctgctccatctgttcatcccacatgtgtcttcacattcaaagcagcaccttccccaagaccagctacctaaccacctcccacctccaccccatccctagtcagaggaaggcctggttcccacctgaattcagctttgtcaaagagcctcctggaaagctgtcatcttcagttagtagggataatgggattattctatctgtgtaataataacatgttcaatttaaagaaaaaaatctgaagccacttaaaagctactgtttggcaccgatacattattccagtaatgaataatcattaaagatattattctggatgcagttaccatgcagtgatgtgaataaaatgcattagatggaaaattgtatttcaagtaaatatatgcactggtagaaatgtattaccacccactaatatgtattaattcaaaaccaaatgccaactggagttcgcctacacgggtttgaatggcaggcagtgatttggaagtgggaggaaataggtttggatttggtcaaatagactgagaagtgatagtgggggcgggggtttatgactcaaactttaacaggtgagaagactatgccatggacagaacaggcatgaggggctcccctcctacgcctctttaagagatttttatctctgactaaggattactggtagttgttgacatttctgaagcagtggatctttttcctttttcactatctgcatcttcaaatattcttttctgaagaaagttaaaaggaagcctgtacattttttgctaaggtaaatgccttgccatcttatttcattttctcatttttttcttcagtgcacaacataagcaactgtcctccttgtcatactcaagatgagcttggcatatctgaaatctgcagggattttctcattagcacagggttccaagcccaaaccgtgaagatggagttttcatttttaaatggcacatcttcaagttcttgccctgtcctcactttagtatgccccagaggaagtcaaagatatggacactctaagactcagaagaactttctcaggcattcattttcctatctattttgagccattttatttaaaaggttacaattttaaacctctctttaattaaaagataccagagttacaatgcaatactatttggcaatcaaaactaatgaagcacagatgcatgctacaacacgaatgaactttgaaacgttgtgttaagtgaaataaaccagttattatacaaggcc

SEQ ID NO: 696 - DNA, 1952 bp, Homo sapiens
taaagtgcagctcaaacgttcgaagaatgacagcaagccctactgagcgtgctcccctctgagactggagtgagagggtcttctggtaagtgggggaggagcacccttaatgattcgaagccctgaggctgtgtgttgacagccctggaccctgatccctgccactctcgcaggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaat

SEQ ID NO: 697 - DNA, 3189 bp, Homo sapiens
tttttttctctggaggatctccgcgcgtggcgagtctgtgtcctccctgtcccccagagcagacaccctctctgtgtctggaccggggaggagcagactctggacagggtgtgtgtgttcagcagtggattgtcagacttggggtcccggctgctcccttttgggtctctccccgggcccgctgatctgactgtaattccttctgctggagctagggttcggccaccttgacgcgccccctctgcccctggagcgtgtctttgggttttgtgtgtgtgggagtggggtgtatgtgtgtttcttatccgagacacctctgggtcgtttgcttggaaaccggctgagggcccgcataccctggagcatttggttgcaaagtgaggcaggtagcgcccaaggctcctgtaccagggccaggttaggcaccaacgcgtcccttatgtctctgcagcctgcagtgtggtggaaccgtttcatagactgaagtgtgaacgtaggaggggatggatatcagagatctgtttatccacattttcagagagtggtattgctctgatgtgagcgtaggcaggttactctctgtgtctcgtgttctttacctgtaatttgaggtttgttgtacctactattaagtggtggttgtgaggattaaatggaattttgacatgcaacagttgacacagggccagacaccaagtaagggatcaatcagttgttgcttttattaatagtaggcatccatctgcccatttgcacgtaagaaggaaacacccaagaatgaaaagtagcttgttgtaggtcacccagccaactagcacatagtggaaattagaatccaggcactcccagcagggcactttccaccaccctgcacttttgtattcatcaggcacagtatccttactgttgtctgtaactgtctatgttcccagtgtctgactctgcagggccctagtggtataaaggtactgagacttgcctgtgttcagggcttcctgaagattaaatggctgccgaagttcttgagtttagctttagctcaaaagatactgcgtcagactctgcgttctgagtagagtctcagagaatgaaaaaagaaatacaatgaaaaaggggaaaacttcaatccagaacctcttaccacagtttctggtagaatgctggcaatttccaggaagatacgtggagaacggaaaggttgctacacccaaatagtgaagcaaaggctatgattatggaggattggacctgcaaactccagaacagagttctgccctctgaggaccctgccctttcccaaaaggggtatcttaagaaggaaaatatggctgctctttgccggacagcagagtcccaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaagcattctccagctgctctcttttgctccatatggtgctgttctctatgtgtttgcagtaattctttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcct

SEQ ID NO: 698 - DNA, 3359 bp, Homo sapiens
aaatagaagttccagctacagatgggcagacacatgccctctcaattcctgatggacctcctagtgcctcctggacctaaggggcctccctcaatgtttcaagatgccaccaaggcagggatcagctcgtgcattcctgagaacatccacgatgaagtgaggctctggaaaaatgcaagagtttccacataatcccaaaaaaccctaaaggtgaactggatgccacagaaagaggagtggtctttgtcacaacaaaatcaacaaaattatttcgaagtcaattaggaaactcagaaatcactcttgctgccattaagaggaagaataggagcctgtgaatggcatccctggcctacctgagactccacagatatttctatgtggcttcagacaccagaaatctccctgattttcagaaaggcagggacagctcctgccagcccatccctctgcagaatgtgtcccagcagatcagtggcatggaaccatcatggacagcacaaaggctcaagggcagcatcccaggccggcctgtgactctagataagttctgagtccccacgggggctcaggaaaggttagtgatgacctggaaagaagggacaggctgaaaccgcccctacgctatctgcaggattccaacttcagcaggaagccaaggaccaactcgtaccacacctgcgccctctgaaaacgctggatacaatcccactctgcagaaagttccacatagaagtggctgggaattttgcattctagactgcattttacagtgcctctggacatgtgatgagaaatttaacattggtgtatctaactctgacatttttcacgaagtgattttttaaaatgtggtaaaaaagacaaaatataattcaaacatatgcattatatgtcaaagtatgcttcgctggcatcaagtagactcaccttgagatacaatcttggacaacctccatcttcagaatatctactttttcaaaccgaaactctccaaccaaaaatcaataacatcaaaagtttgcaaatacaagccgacggaaaataaatacatgaattctaccacagtgaattggaccgcactgggaaacacagatgaagaaagtcaataccgctttgtccttcagtgcctggctcctttttcagctcgtcttgctactctaggcattatgcctgaaaagtctcccaggtgcctgtgaggctctaattccctgggtcccattgccatgtctctggatttgcgaagatccaccggaccttctgtggaactcccgtgtcggtgaacttttgtgccacgtcccctaattctgcccatggtcatctgcagctgcacgagttagggtcggtgttccttggacgggaagagacaggcaggagtcggaatgctgaaccagcacactggggcgttttctcatgtagcccaagtgacccaaggtcttcttgagctttggaaccagtcgcgtcccacttgacacagcacccgactcccagtttctcaatcgtgttggccctccggcgatctcccgttggatgaattgcacaggctgaaactcgagtcccctttgatttgcgcttcattaattattcatgattcaggttggaaggcctgctgacgaccccctgtggccgttctctgagctttcctgtcacatcgtttccttccacgctctttggttccttgtggtcctgctccttctgctgtcagaggagcagagagttgatcttattgattctggatacggatactttctaggtgatctggataatcaggataacgaccctcaacagcggcggaaagggagcagccatttggtgcgtctcagaaaatcgcgctcagttccgaggcctcctagatgtggaatcctgctcagagttgttcccaggtcagagaatggagagagcctgggcatgatgggatatccctgcctagatctttcagtgagtctctacctcagctactcttaggatcagggggagaaccatggaaaggcccggtgtcagacatccggaaagaagatgggatgaatgttttacctctgaagtacatcccaaatctgggagttaacttcagctttgctgggctctatttggccagtgaaactctgcctggttcattcgcacatccggaagccacttcacggggggccgtcgcaactggaaccacacacttggcatcggcggttgagccaaatggggacttgtggtgcaagcaacgctccccacgtgttagcgtgcgtgagattcagttggcggaattttactaggtgtgtgttggtagagtggggctgaggttttcttgctcctgtggatgtatacgaagtcaaaggtcctgcccagccctgcggtcccctcagtcaactctgtttcagagacataacgatttggattgagaacaagtcaagacattttcaagcccttggatgtagggaaaagaaagagagatcagactgtcactgtgtctatgtagaaagggaagacatgagactccattttgaaaaagacctgtactttaaacaattgctttgctgagatgttgttcatttgtagctttgccccagccactttgccccagccgctttgacccaacttggagctcacaaaaacctgtgttgtataaaatcaaggtttaagggatctagggccgtgcaggacgtgccttgttaaccaaatgtttacaagcagtatacttggtaaaagtcattgccattctctagtctcaataaaccaggggcacaatgcaccgtggaaagccgcagggacctctgcccttgaaagcagggtattgtccaaggtttctccccatgtgatagtctgaaatatggcctcatgggatgagaaagacctgactgtcccccagcctgacacccgtaaagggtctgtgctgaggtggattagtcaaagaggaaagcctcttgcagttgagatggaggaaggccactgtctcctgctcgcccctgggaactgaatgtctcggtgtaaaacccgatcgtacatttattcaactctgagctaggagaaaagctgccctgtggcgggaggcgagacatgttggcagtagtgctgccttgttattctttactccactgagatgcttgggtggagagaaacataaatctggcctacgtgcacgtccaggcatagtaccttcccttgaacttaattatgatatagattcttttgctcacatgttttttttgttgaccttctccttattatcaccctgctctcctactgcattcctttttgctgaagtaatgaaaatcataatcaaaaaaactgagggaactcagaggccggtgccggtgcaggtccttggtgtgctgagtgctggtcccctggacccaatgttgtttccctat

SEQ ID NO: 699 - DNA, 2130 bp, Homo sapiens
actcgcgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttatacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaat

SEQ ID NO: 700 - DNA, 2556 bp, Homo sapiens
agctgaagtttgaactggggagaagcgccgccttctagtcgcagctcctgtgctgtaaacaaagagtcctttccgcagtctgtttactgacacttttttttctgctttttgtgggtggttttgctttctaaaatggcccccaagcgtagtgcttaagctctgcccagtgttcctaagcgaaagaagaccgtgatgtgccttacggagaaagtccgcgtgttggataagctccaatcaggcatgagttacagtgctgttggccatgagctcaatgttaacgagtcgacaatccggtacatcaagaaaaaggaaaaggaaattcaccgatctgtccgtgaggccgctccggatagtgctgaagtgacctccatcgtgcgtgatgaagctatgacaaagatggaaaagatggaaaagcggctaaatttgtggattcatgagatgtcaatcgattaaaaaaaacatagtggacagcattgtggtgaggctgaaagccaaagatatctgtggtcacgttacccagggtcaaagaaatgctaagcccttctcggcgagtgctggccggctcgcgtttcaaaaggcgatacggggtgaaaaatgttaaacttgcaggtgaggcgagctctgcagatcaggaggctgcggaagaattttaaaaatacttgctaagtgttatacaggaaaagggttatgtgaaagagcaggttttcaatgcggatgagactggcttattttacaaggatgttggcaaacgaaccgatataatgcaaacggcctccaaagcccctggctttaaatcatgccaggatcatgcacccttgttattgtgcgccaatgccaagagcgactaaagtgcaaactcctaatggtgtaaagaacccaaaatccacaagcacttaacgggaaatacgtgaaccatctgccagtctattggaggtggaacaaaaaagtgtggatgatgtctgattggttccacaactgcttcatcccagaagctgaacactgtctccagggcagaaaccttgccttcaagggttttttgttttgttttgttttgttttttgtttgtttgggtttgttttgttttggtttggttttgaaacggagtctcgctctgtcgcccaggctggagtgcagtggcgcaatctcggctcactgcaagctccgcctcccgggttcacgtcattctcctgcctcagcctcccgagtagctgggactacaggcgtccactaccacgcctggataattttttgtattttcagtagagacggggtttcaccgtgttagccaggatggtcttgatctcctgacctcatgatccgcctgcctcggcctcccaaagtgttgggattacaggcgtgagccaccgcgccgggcaccttcaaggttttgttaattttggataatgctacaatccgttgctgcaaagaactcgaaaatgcacacgccaacataggagttctttttatgcccccaaacactaagtctctcatccaacccctcaatcggggcataataaaagcattcaaggcacactacacaagggagctttatatgaaggcctgtgaggctctcaggaccaacaaggaaaccaccatgctggactattggaagtcggtcactacatgcaacgttattgattatgtcagtacagcctgggagagcattggtcaggctactaccaataactgttgggaaaatgtttggccagactgcgtggagaattttgaagggtttgaaggtgttacagaaaatataaagaacactgtcagagacataatgcatatggcacagcaggtaagtggagagggctttgatgacgtgaaggaaggagatgtggagtacattttggcagagaaggcagtggaaccaaccaacgaagacctggatgagatggcaaaacaaggcattggagttgatggccatgaaagtcggcccaagacttccagaattgtccctctcacagcgccaaaatatcagaatggagttctgccttggaaaaaatttttagcgacatggaagagtgtgaccctacgcttgatcgaagcctcaaatttaaatggctggcctccactgcgtttgccccttataccgagatgcttaaagatttcaggcagaaaagccaggcaggcaaggctaatgcaatttctcaagccagtttgggagggaagattgcccactccttcaacaagtgtcaagagccagactcctaaggtagaaatgccagaggttgacctgccaccctcttcctcttctgcagaataaatttcactcacccctcccctggtttctgtggggcaagccaaggtcgagaggtttaaccacattgtgcagctccatcaaccgtaagattttagttgatatttttataaaacttaggatgctccatctttgaactttttccctttatttgtattgctgtactgtagggtatacagtatgtgtgcaaagtagtgtatgtgtttactgtgggaactgtacagtatgttatactgttgactgtatatgggaactatatgtgtgtactctgtgtgtgccaatgaagaggttgtacaggc

SEQ ID NO: 701 - DNA, 1982 bp, Homo sapiens
gttcattactttcttgtttttgccaaattaataggtgaagatggcctatcaaaatcattttgattttcacttctttatttcagatggagtttctctcttattttccaggctgcagtgcagtggcgtgatctcggctcactgcaacctccacctcccaggttcaagcgattctcctgtcttagcctcacgagtagccgggattacaggcacatgcccccattcccggctaatttttgtatttttagtagtgacggggtttcatcatattggtcaggctggtctcgaactcctgacctcaggtgatccgccttggcctcccaaagtgttgggattacaggcgtgagccacccactgtatctcttgttcggaggaatatctaatcaagaaaatcatttttactgtttttattttttggtttgttcgtttttttcctgtgagatggagtttcactcttgttgcccatcctggtgtacaatggcgcgatctcggctcacttcaacctccgcctcccagtgcgtccggaattggtgggttcttggtctcactgacttcaagaatgaagctgcgcaccctcacgaacttgtcagatatgctctcccagcccttcttactaaggacaatgggtacttgtccaagcccatccaccattctgtcagtcgcatcctaagaagagatcagagaagattccctcctagaccacgcaaaatagaccgatcatctttggcacgtgtggccatgacccacatgaggatttataagcgacctagtcaccgggacttcatgtggttaccttttctgaatggctcccggttctcctctgcttccctgttgactcggttttgttctggttcaacagcagacccctggtcatcaagttcatcttctgtttcatcatcactgtagggaaccacttcgtcattaggctgagaatcctcgtcaaatgtcgtttctgagtctctttctgtactcattctgctggcaaattggaactacctgcttaaaaggaaagagaaaccagagtgaattatgactcttgcccagtttttggttgaatactgcctgcatgctgctacaatgccccttttacagaacattgtctaacatgtaaatattctggaatagtacccccaaattcaacttgacatgaaaacaagaacaaaaccattcagtactgattaaatgcttgggataatgtgcaacaatctaggtgatccgaagagtatttgatgacattgcattaatgaccttaagttaatagctgcacccttctggttaccgctagaactgagctttcgctcgccgtccaccactgctgttttgctgccgtcgcagacccgccgctgacttccatccctccaatccagcagggcgcccgctgtgctcctgatccagggaagcacccgttgccactcctgatcgcgctaaaggcttgccattgttcctgcatggctaagtgcctggtttcgacctaatcaagctgaacactagtcactgggttccacggttctcttccgtgacccacgacttctaatagagctataacactcaccgcacggcccaagattccattccttcgaatccgtgaggccaagaaccccaggtcagagaacacgaggcttgccacatcttggaagtggcctgccgccattttggaagtggcccaccaccatcttgggagctctcggagcaaggacccctggcatctggatattaagactgtctccagccctttgaggttgagagaggaagcaagcacggaggaatggatttgacaacccacatgtccgtgactcaaagcaagcaaggccttgcacaaccaactcgccacccacacaatctgcacagtctcagtgagaaaccaggagcagggagctctccgctgagagtgaagaaatgtcctcaactcaacttctctgcagtgtgcatgtgtgtgaaacgcagacacacacgggaggaatttggctctgtcattttagtgtacc

SEQ ID NO: 702 - DNA, 1677 bp, Homo sapiens
atttcaagtccaaggtattatgtattctattttaactgtttcccagttttgtattttttgtattggaatgattatgaaattaatgagaaatctttagaaatcagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtgcaatccagaggaatatttttatcaactattttgtaaatgcaagttttttagtagctccagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaccatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaat

SEQ ID NO: 703 - DNA, 2517 bp, Homo sapiens
gagccggaggagaggaagatggcggcggccgccagcacccgcggtgccgcggggccgctccgaggagcctgagagacccacggaggcttctcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactgcaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgaggccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctag

SEQ ID NO: 704 - DNA, 2187 bp, Homo sapiens
actgcttttgtggcgccgacaggtaatttattttatttacttattctggtttgttgtccgagtccccatagaatgctagctactggagggcagggatcttctgttgctcactgctttattctcaggatctgacacatagtgcttgactcatagtaggctcttagtaaacatttggtgagtaaatgaataaatgaaacgtccattctcggagtcgggttgcttgggggggaaaaaggaaaggaaatcaattaattaattaaatttaataataaaggccgggcgcggtgggtcacgtgtgtgatcccagcattttgggaagcagaggcgggcagatcgcttgagcccaggagttcgagatcagcctgggcaacacagcaagtccccgcccgcctcaagaaaaaagaaaattagctgggcatggtggctctaatttgtagtcccagctactcaggaggctgaggtgggagaatcacttggggctgcactccagcgtgggtgacagtgagaccccatttgttagaaaagttggccggcgcgctggctcacgcctgttaaccccagcactttgggaggccgaggcaggcggatcacgaggtcaggagttctaaaccagcctggccaacatagtaaaactcccgtctctaccaaaaatacaaaaattagccgggtgtggtaacatgctcctgtagtcccagctactagggaggctgagatgggagaatcgcttgaacccgggaggcggaggttgcagtgcgccgagaccacatcattgaactccagcctgggtgacagagtgagactctgtctcaaaaaaaaaaaaagttgtggtcataaaacttggttcagatgccgtcagcggcatgccttgcctagggtcttgccctccttgtggcctctgcacaccctgcctagtctttccttccctcctgacctttctgaatctgattcatccttttgccccaagcagaatcccaccttctccaggaaggtgttagcctttgtaggacccactctgggacactggtacctgctgcctgtagccgtggcctttccccttccagagggcagggcggtctcagcaccctcttggtccacagctgatcttttttagctgctgaagggtctggggctgtgccctggggaagccatgacactcccctgcgtagggtcactgggtggctcctgcagccagacttggacaccctccctttgcagatttctgtctcctccccaggaaccagctgccttccttctggggcgaattcattcttatcccacagccccagcataatgggatctggctcagggaggcctttcctgatctgccctaggtttgccttccctgtgagcagcccttactgtcctctgccttccccgttgagctgcagggtgaccatggtcaagcaggagcctcagtgggaaggtgctgaggaaggttcatgtgagaagtggctgtgggagccctcaagagatggaagttaggccaggcgcggtggctcacgcctgtaatcccaacacttcaggaggcagaggtgggcggatcgcttgaggtcaggagtttgagaccagcctggccaacatggcgaaaccccgtctctactaaaaatacaaaaattagctgggcttgtggcaggcgcctgtaatcccagctactcgggaggctgaggcaagagaatcacttgaacccaggaggcagaggttatagtgagccgtgatcgcgccattgtactctagcctgggcaacaagagcgaaactctgtctcaaaaaaaaaaaagaagtgagaagtctgtggctggcctactgagtgtccgcacatacaccccttaccccacctgactggtcttcacaatcaatgctccccaacagccagcggtcctgggagtccaacctcccagaaggatcacccactcccaccactctcaaggtcagagcctggcctttgggggaaagggcagtgctgtctccagggcctctgcacccagggacagtgtctgtcccacccctggagtgccaacagagttgggagactcagcactgacttcaccccaaaatccaagtaagctgggtattgcttaaaatcaggggccaggcgtggtggctcacacctgtaatcccaacactttgggaggccaaggcgggcggatcacctgaggtcaggaatttgagaccagcctggccatctctac

SEQ ID NO: 705 - DNA, 1985 bp, Homo sapiens
ggtgcgtgcccgggactctgccgatgcgggccgcgccccctggggccaagagactccacgtcccgctcagggcaaagggtgtggggagaagcggtcacgcccctcggctggaatccgtgaggaccaggtgagcagccttctcccagccgggactcagggcgctgtctccccgagcctgggcgggcggcgggtggcgcgcccagaagtggcccggcgccgccggatgggcggctctgcccctcagatctgcgggagggagattcggctggttcttggaaaggggagaactcgaccagccctcggcgccttctgggccaagcttaacccccgtgcaacctttggacaaaggcatatgggatgagaacgtctgttggcctggtgcactgtgcgtcctctgagaggtgaaggagcactgtgtggtcagagggctgcgagctctctgtttgggttccgaggaagacagaatgggctgaactggaactgacctaaatgtcagcaagaggagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaacc

SEQ ID NO: 706 - DNA, 2023 bp, Homo sapiens
gtgaaaggtgctgtgaccgccctccgggttgtggctggtggccttcggtgtttcgggtttggcagttcactcaccaaggtgatctgatggagtgcacttcgcacgattccaagtacttgcctaatgttcatcctttcctctagacggggtagggctggttctggatctttttccgcggtagctggagagacgtaggacctgatgatggctactagatgcctgagaagggagaagacagaggagaatgccagatgaagacagaaacagagattgaagttatgtggccataattcaaggattgctggcaacaccagaagccaagagaaagatgaggaagaattctcccctagacctttcagaaggagcgtggcccagccaacaccctgacttcagacttctggcctccagaactcagcctcctggccggggatagccaatagccccagcccactgaaagcctggtgagcagaaagggaagagaaacaagggtgttcattcactggtaggatgtgtttcctgaacggctcctgctcctgctggacaagcccacagagggcccagcttccaacagactatgctccaggaagcccaggtgtttcgaggacttgcttctacggtttctttgtctgcggaatcagggaagagtgaaaagggtcagccacaggattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcgtccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccagggaacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtc

SEQ ID NO: 707 - DNA, 2141 bp, Homo sapiens
aaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgactcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaagcttgaagtagaacatgtgatgatgagaaaaattattaaaaaacaggatgaccaaattgagcggcttgagaaaatcctgcagcattcaagtttgatgctgcaggtgtttgagagctagatgaagcatccagccaaactagactacatggagctccacagtgatcgtcttcacctccagctgtttgcatttacttcttccctctatcctacatgtgttttccttccccttcagatatcaacctatgaattgcctctaccaaaaagcctacaatattgacacaaacctgggctagtatcccttctatgtcttccaataagtgctgtcttatgcttgtcattgtatgtatgactctgtatgggaattgcctgtttgttttttcagattatagcatacagttgttgaggggcggaccgtatcatctttatcttgtaattccagtgcttgtcctagtaccttagcacatggttgctgaatacatgaacgaagagtgagaaaccagaagctctgatacttaactgccatgataatgaattcggtgtgcaactatgggcaaattatatttaatagtaattgcatattgtacatatttttcattcttattaacactgataagcttttcagcatatactgactttctcttagttaactgtgaaatcatttagataaagaatataattctttttcattctaacttctgaatttaaatctgaatcctctatagcaggggtccccaactcccaggccacacacagttccatgacctgttaggaagcaggctgcacagcaggaggtgagtggcaggcaagcgagtgaagcttcatctgtatttccagccactccctgttgctcacattatcacctgagctctgcctcctgtcagatcagcaaagccattagattctcacaggagtgaaaatcctactgtgaactgctcgttcaagggatctaggtcacatgctccttatgagactctaatgcctgatgatatgtcattgtctcctatctcttcacgatgggaccatctagttacagaaaaacaagctcaggactcccattgattctccattatgatgagttgtgtaattatttcattatgtattacaatgtagtcataataggaataaagtgcacaatagatgtaatacgcttgaatcaccatcctgaaaccatcccccaaacccccatctgtggaaaaattatctttcacaaaactgctgcctggtgccaaaaaggctggggactgctgctctatagcttctgcactagaatctactaatgagtaaaatttaaatcaataactagttttaaaagcataacaagaatatgtgctgtctggctgcagtggctcatgcctgtattctcagcactttgggaggccagtgcaggtggatcacttgaggtcgggagttcaagaccagcctggccaatatggtgagatcctgtctctactaaaaatacaaaaattagctgggtgtggtggtgcatgcctgtggtctcagctactcgggaggctgaggtgggagaatcacttgaacccgggaggcggaggtttcagtgagccaagatcgtgccactgcactccagcctgagcaacagagtgactccatctcaaatgcaaaacaaaacagaaagaatacatgctgacgaaaaaaatctaagacaataaaattgtattactaggctgttaacatgatattttgtttcccgttaaatgtgtgacatgcaaaagtatttattgaatgaaaatattttttatct

SEQ ID NO: 708 - DNA, 1853 bp, Homo sapiens
gtgtgaccactgtgcccggagggaggcggcggtggccagtaatgcctgggaaactcctctggggggacattatggagctggaagcacccttggaggagtccgagagccagaagaaggagaggcaaaagagctttatggatatcgcaatttcggataagggattatggacctgtacttcccttatagggttgttatgaagatttaaacaagataagctgaaaacacattacacagtgctggagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 709 - DNA, 1669 bp, Homo sapiens
gaagcacccggcccggatcgcagagcccgcgccctgcgccggcggcaatgaagatctggagctcggagcacgtgtttggccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatgatgcttcccagaagaaaggaaagaaggaggtgaggagaggacgagcaaggacgggacggaagagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggcccttaggggcggcgcccatcgtcctgcctgccgcggtggcccagccccttctctccctgcaggtgacccgcgccgcccccgcccgcccgcccacgctgtcctccacttaggcgcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggat

SEQ ID NO: 710 - DNA, 1727 bp, Homo sapiens
atgcttttccttcccagctggagaaggcctcagctgtgtcagactgggactgctggtgatttttctgtagttagagggaaacacaaaacgaagagcggcccactcccagcttacaccgatggtgagcccacctctcctgatcattagcgttgctggcacaattgaatgcaagccagatcatctcttatggagacccggcagtacctcacctcagtctgtgagttttctccatgggaaggttgtgatggagtctctgggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatgacaatcatagtatgttttattttcctgagggggaataacttataatgctgtttagttttgtactattggtgtgttggtgaatttttaaactgtgtgctaactgcaataaattatatgaactg

SEQ ID NO: 711 - DNA, 2204 bp, Homo sapiens
tggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagagtagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagctgtcacaagatgaaggtagaggcacattatacaaatacagacctgaataagtagatattgatgccaagttaagccgattatgtgaacaagataaagtggtgcatgctctggaagagaaacttcagcaactccgcaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaaaaaaaaaaaaag

SEQ ID NO: 712 - DNA, 1797 bp, Homo sapiens
acaacccaactgcttgcctaatggcccgttcctacctccatctaaacagcagtaacgaaacgggcgttcaagcagcacaaagagggtccttggtgacagagagggacgtcagggagagggtcgcgggggtctggctgcgcaggggagaggctcggggcgacgagtggggctgggcggctggggcctgctggccgcgtccgtcgccccgagcggggagatttcggcgggcctcggggcgctttggagaccagggccagacggtgcctccggcccggctgccgggagacgcagcggtggggccaggcccactgtatctcaaacgaaccggggaggcgctgaacagccacgggccggcagcccgggcctcgcagacactgaggaaaggctgggggcgcccggggcctgaaggagcagggcgctgagggtctgcatggcccctctgggggatctggcggcggagtcgcagccgtccctggggcgcggggtagtagtggcaattgtgcgagccgacaggagcccgcgtctcggggagggcgggccggcggctgaggtatacaagaggatgaaggtaggccggaggggtgtcccggccgcctctcgaacccctgcctccttcacctgccacgaacaccacgaagaccgcgccgctccttttggccgtcgcgatggcggccggaatggcgccctggaaccacagcatcgctcccttcgggcccaggcgctcgctcggtgtgtagtctccgcagtcccgaagccggctccgccctccgtcttcgtccggctctgcggcccccgcaaccttggctggttcggcccccacctccggctccgcacaagcgcgcacgcccgtcagcggcacccggagacgcgcgctagcgcgcgcgagaacacctcacgtcacagtcgcaacccgtcggtgtccgtgccccaggaccttctctcgttggcgagtcgatggtgcggccgcgcgcccgctaggcctccggtcgcgcagtccaggaagtggaggaaggcggtaagagggatgactaaccgctaagacacgtcggcggcgcctgcagtgaggcatgatgggaattgtagtccacttaggcttattcgcctccatattgtggagcatgtaactgtgggttctgaggcacagctaaagggggcagtagtgagggccactacacattctataaaggggagagggagaaataagtgtcactccaactggcatatgctattctcggcctcgttgagactctcagtgtggaggaaatagtcctcgcatggaactaaatgggctttgtcgggattaactccgaggctttgatttcttctgaacgtagcccaaccttgcagaaaaacgggataaaaaccgcaagtcaccttctttaataacctgtagtccatgtgcctaagcggaggaattggtagaacgcaggccttcagcaatttcctagacactggatagagatcatttcaaaacttcaaaacgcgttaggctattgccacagctactttttaaagtaacacaaagcagagaatagattatttcttttccagctactttccatggtaatacaaaagagactagatagggatttattttccaattttctgggagaatgtcctataatcaagatgtggcgctttgtgattggctgccattaaatgaaaactgatccatatttaatactttcgtgaaatcacatggtctgtaataactattagctaaaggcttgcatggtttatttaaagttgcatatactattatgttaaattctacatcaattaaatttatcctccagc

SEQ ID NO: 713 - DNA, 1835 bp, Homo sapiens
acaagtaacgtgagagaagctcgggtagaggttcgaagagctgggagcgcagggcggggacctcgcacgggagggtgcgggcgggagcctgcctcgcgagcccgggccacggcggctgctcccgaccgtgactgggacccgggcagggaaggtcgctacaaagcctgccgggcgaaccgaaggcagctttgtgcggagccatgccaggaagcttgggaaccgtgagccacaagagaacagcgttgttttttgcatgttttgcacttagccagaggaagtctggcgcatccgagccggccagccgagcacatctggaagtggtttctggggccgcccctctctgccagcgcaactcctgggttcccagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaact

SEQ ID NO: 714 - DNA, 1993 bp, Homo sapiens
actatctggcaactgtcagatctgagtttctgtcctaaaaatgcactggcaaattccctactctcataactgacccatttccttatttaaacacacacccacagtgtctatcttagcaattactgagacatgtttagtgacctttccaaatctattatctcttttgttatggatgtttccccagagctaagaaaatctttgtgtggagcagatgcgtggatgtgttgcatggatctcacatagtttatctttgattggatgctgtggtttgaggctgagggctgcttccatgctttcctctattgtgcggcaccctaaggctactcatacggagagtccagggacttgttcttgtctgggctgagagcctcatttctgcatgtgatataatggactcagctcttgatgtgctacttttatctgggtgacaaaataaaaacaatttcatttcaggctttcattcttatgcatctgcttctaccctctgagtactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcagtgagtaaaggtccccatcctgagtcattttgggtatagagaggataatttggaggttaaagttggcattggctacttggcaatattcccttggtctggttgggtgatgttgggaaaggcaggaggcaagttaaacccatttttggagtttttgcacctagggactctcgggcccggccaccttatactgttgcggctgacaaatcaacacgtaatgagttccgaaggttcatggagaagaatccagatgcctacgattacaacaaggctcaggtcatctggaataggaaggacaagcagagtgggaaggcatcacagatcctggctagatcctttctacttcttgcagttttaccaaagataacttatagggtcttatatttgaaatcctccaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctctaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaagg

SEQ ID NO: 715 - DNA, 2179 bp, Homo sapiens
cccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggc

SEQ ID NO: 716 - DNA, 1984 bp, Homo sapiens
accggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggtgagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgcc

SEQ ID NO: 717 - DNA, 2167 bp, Homo sapiens
tctgtgccgagcccctcccttcgaatattctcgagtgagaaaagatatttcagtgagttgaaaggaaatgtgtttcggcttggtcaggggtccaccttctctggctcacagaggaggcccagcccaggcaggcggaggatacccagggtgaggcggagccccttggccaccagagtgctctctgcccccagtgttgaaaatcacatgtggccccaggacatcgctggcaggcactatgtcgtccgaggcccagagatgaccccttatgaaggtggctattatcatggaaaactaatttttcccagggaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcaccttgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagcttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccggcccgggtgttcgctgtccacggaacatggcagaggggcaccccggcccggaaagacgccagagccagcaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctg

SEQ ID NO: 718 - DNA, 2178 bp, Homo sapiens
aagcatggcggcggcggcgttcgtggtccctcgggtgaaacagaaagcgggagctacgcggagagggagcgaagagcggggctgaggcggcggcgtcactgccaggaaacaaccccaacagtcagcgcgccggcggtcgcggcggccctgagagctgactctgcagctgaggtagagagacaacgatcaggaaccctaagaagaggcgccagaggagccgccttctgcctcagaacggcgtgactcggagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccgggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtgtaggtatttgttgttttgctttctcccattgtgtaaattaatggtttattataaagagcttattactaattttgctctacttttccttcttcacgcttttattctgaatctttaagttggctaatgatagtgatttcaatgtaaatggtccaaatgtagcttggtacacatttctgtctaccttccttcagaataatcacttttattggccacattcagctttttttttcccagtaggctccctaatagatggttcagtattcacgtattcttaatgcattaaatataagttgtagtatgtagaacccatgaccaaaaatggacaattcatgattgtaaactcataaagtatgacattgctcctctaaggactggatttaattcttacatgtacaagctcatgtcctgttgtaaaatgaatttagtagcactgttatttatttgcatgttagtatgtttatagtcatattttgaaaacttacgtatttctttcctcggtttaaaagtatattacacacagccaggcacggtggctcacgcctgtaatcccagcactttgggaggctgaggcgggtggatcacctgagttcagcagttcgagaccagcctggccaacacggtgaaaccccgtctttactaaaaatataaaaattagccaggggtggtggcacatgcctgtagtcccagctacttaggacgctgaggcaggagaatcgcttgaacctggcaggtggcagttgcagtgagccaagatcgcgtcattgcactccagcctgagtgacagagtgagactccatctcaagaaaaaaataaaagtatattacgcaccacgaagccttagaaagattcagtagctaaagttgtgacatttatgattgacagttttgaaataaattattctgtccatattc

SEQ ID NO: 719 - DNA, 2286 bp, Homo sapiens
accagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtttttcacgactgaaaataacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgttttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgccctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttaattatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcccaaagagcagaacttggagtttctcctttatgtagagaagaagtaacttagggtgtatttgcaatgaaatattcatagatattgaaagcttgtgtttacatgaaatatgtttattatcaagaattcctttttccaattctgtacattaaatatatgtgttttaaaggg

SEQ ID NO: 720 - DNA, 2454 bp, Homo sapiens
acatgcgcacagagcccgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttcagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctggagtgcagtagtgtgatcatggctcgctgtagccacagcctctcaggctcaagtgatcctcttaccttagcctcctgcgtggctgggactacagatgtttgccaccatgcccgcctcatttttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcggaccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgtgcttagcgcaaatggcagctctcatcatgaatgatagactctttcaccctgctggtcccaggtcggcacacacatcctcataatggcatttctcctttctgtgcacagcactttattgttacaaagtactcttccaaaaagttaccctgtgtgt

SEQ ID NO: 721 - DNA, 2060 bp, Homo sapiens
aatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttgtgccacttctttgtttaatatctggactaaatacgcccccaggctgccagcagactattacaacgaaaagcttctgaaggttggagatagcctttgtcaaatgaaagaatacaaactggcccttttacaatgctatggaagatatcttcagcagttcaataccaattttgatgagaataaagtggatgtaactcaattcaaagctacctttttcccaaaaggctttaaagataaaactgctggacttacatttcatgctttgagtggcaaaaatatgtgcaactaccagctggtctgcgacagtgatgaaaacctgaagaataaagaatctgtggtccagtgtctgcatatcttgtcctccttaaggctcatcatgcaagcggctctgccacaagagcatctttgctggattatcttcaatggtaccatttatatttacaccatttgcagaaaactgatggtcataggtcagtcttccaaggccttagagtatctcctgtgggccagcatgtgtatggagtccttggtcccgctcctgtcactcaggtacttgacatggcgcgctactctctacacagctgtttgccagtgctgctatgactgccatgccgggattcacggagaggcatttgctcggcgtgctttggctaaaattgatgagttaaggcaactggaattaatgagttcctcaaaatcccaggaagaatcgcgaagatattttcgagaggccacaatgaagatggcagtgatgatcttcaaaagaggagtctttgaatctagaagaaaaaacaaagctgtctttagacctaagataagaattaacctaagggaagtacaaactttatcatggccacgaactgtcacagagcggctactggatgagatgtttgatagcactgcatcccagtttctggctgtcttggaagctctttctgattcaaataggcgaatactgcaaactggacccattgttacagatgaagtggagattcatgatgttgtctcagaattgtttatggcaggaaaagaacttttgataatgtcaaatattggtgcagatggaatgcttgattttccaaaaacatctcttctggaacttatgataggaagaaaagatgttatttctgtggatgctgctgtgaaatttataaaattagcttttacctatgaggagtggagtttatttgaatcttctgctgtacatcttatttattttctccagaggcaggatgatccagagtcaaagaaagcagagaaggatttaactcttctgattgcaatggaaccactaatcaacgtgaagagaaacaaaggtttgatctttcctttggaaaactataaagaaggacagtcaactcaaatttatttaaaaaaaattgctgttcatgatacttgtttgaagacttgtggatattcagaggatattttccatttggcagcaaccttgtatgtctgtgtctgcactgctccccaggatgttcaacctgataaagaaattgttgtggacacgataatgttcctatggcagaaatgcaaattaggaattcagcggctcaatatatccagaaatgactatgcaaaattcacccagaaaatcagtactaacaaatggatttatcttctgtggcagataaatgaagtaattcactgctataaaatggaagacattgacattgtggtagtggcagaagtcacattacggttaagtgaaatattggaatctttaggaagcccaggaag

SEQ ID NO: 722 - DNA, 2002 bp, Homo sapiens
gctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgacgctgccaacaccactgctcctctatttataagtcttaatagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtctctcccaccttctcctggcctccttgtaaacccaaaccgccaggtacctcaattttcttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagttggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggctctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagt

SEQ ID NO: 723 - DNA, 2436 bp, Homo sapiens
agtagcgcagcgagaaggatcgccatcacacggcgcactggtgcggcttctcccccgagtggatgaacatgtgcttggtgtcgtttttccttgagctgaacgtcttgcaacagtggccgcacgcatagctgccccagatcccggaagaaaatctctcccacaccactgtagtcagagaggccagtgggtgcatggaactcctcgcacgcgctgtcagcagcagcagtgaggaagccggcagcacagtctgggaaggaaggaggtgcttggctctctcccgggccgccaccttcgccgtcctcgccatcggtctcatcgtcagtttcctcgtcatcgttgtcacctcggtcgtcaggggccgcggacagtgaggggtaggcaccaagcccctcggctttggcaggtgtcgggggcgcaggcagctgcaaactcgcgggccggcgctgcttaccgctgtgcgcggcaccggggtgccccgggggtgcgcagccagcaggtggcgcaggcggtgacgcagctgctcaggtgcgagtggcgggggcacaggggtgggcaggggcgcgggtgcagaggtgctcgcgggtgcagaggagcgcgtgcgataatctgcgtgcattcgtcgataactgtctatgcgaagcaccgacgcagccatgagtacctgcggggcttcactctgtgccacaacgagcgaaccgctgtacaggagctcgactagctgtcgcaccgtctgcacaggcaccaccgaaggcacacggatctcagaggggccgagcagcagcttgtcttggaaggagggcgagccgattgccagcccgcagcggtgcgcacgcagcgaagcttcatgaatgcacacagtcacgtcgcagaagtgcccacccagcttttgcccattgagggtctcaagcagagagcgtgagaagttctgcagatgtatgtggcgcacagcctctacagccgccgactccgactcctcttcaggcaccaggcctggccgtggccgccttctcaccgactccaaggcagcacttccgggcgcttctctttatttttatacagttttattgagatataatttacatgctatccagcccatctatttcaagtgtaccatgcaaggggtttgtatatattcacagagttgtgtatccatcaccatcgttttagaacattcatcactccagaagaaactacctacccatcagcagccactgcccatttccctgatctgccccgccctaggaaatccgtaatcactttcagtctatggatttgcctattctagaccattcatataaatgaagtcacacaacactgggtcttatgtgactggcttctatcaaagtttgcaaggttcatttatgttcatgctgatgatataaactggctcatttgatgccaagactgaccatcaccaccataccaaggtcatcactgatcagaggcctaacccaaggagggggtcatgtgcagacccagctgtggggaggaaagatgctgcagaggagacggatgcccacagaggcccctgagtggatacaatgctcactaagtgggctgaccccacattggacaccgctgcatccatgtccatcacacaacacagctgccgtttcttctgcctgcttatgggaaagtcccctcttctcctccgttttcttctcttcctgccctatcacaccgtgcacttctccctttccttaaagaaccaccatcaactttaggaggagggaaaggggtggctctggcaggaaaagccagaatcccctctagccagcagagagagagaggaatggctgcatgttttctcccccagtccaaggcactgggtcttggctgggttgaaggttccaagctgctctcctgctgtgtcggtgagttctggtcaacctgcaacctcctgatatggccattgcagttcatcgagtcttcagggactccccatggcctggagtactttgccttgcttacacgggagaggagaatggatttatagagaacatcatctaaatccaacttgaccattgtgtggccacacttgctagattgctatagtctaaatctagcattgtagaaagacgggggagcttggagctgcacaaacccaggtctggaactggctccttaccttggaaggtgaatgatcctgccaggactcttagcctccctgggtctcaatttccttatctgtttcatgggaatgaggatctctgctgggtggttgggtgatgtgggggctgtgtgaaaacagcttgtcaatacaagccaaaatagaaatatttctccacagagtatgaaggtcaaatgagagaatacatttaaattaaatggaaaattaaaatggtaaaaaatgcaaagctgtattgaaagttccgagcttctctataaggagctttttgactatggaagaatcctgtactcgttccccctaaatat

SEQ ID NO: 724 - DNA, 2443 bp, Homo sapiens
tctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggggttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctc

SEQ ID NO: 725 - DNA, 2233 bp, Homo sapiens
tttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaaat

SEQ ID NO: 726 - DNA, 2132 bp, Homo sapiens
tcttctagaggcccagcctctatggccctctgacctgcaggtattggcgatccatagctaagacgccaggtcccccggaaacctagaaatgacctgatcacctgtctggaacaagaaaaagagccttggattagaaagagacataggatggtggccgaacccccagttatttgttctcattttgcccaacacttttcaccagagcagaacataaaagattctttccaaaaagtgacaccaagaagatatggaaaatgtgaacatgagaatttacagttaagtaaaagtgtggatgagtgcaaagtgcaaaaaggaggttataatggacttaaccaatgtttgccaactacccagagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaaatttctacaaatgtgaagactgtggaaaagcctttaatggatcctcaatctttactaaacataaaagaattcatattggggagaaatcgtacatatgtgaagaatgtggcaaagcctgtaaccagttcacaaaccttactacacataagataatttatactagagacaaactctacaaacgtgaagaatgtagcaaagcctttaacctgtcgtcacacattacaacacatacaataattcatactggagagaatccctacaaacgtgaagaatgtgacaaagcctttaatcagtcctcaacccttactacacataagataattcataccagagagaaactcaatgaatataaggaatgtggcaaagctttcaaccagtcctcacaccttaccagacataagataattcatactggagagaaaccctacaaatgtgaagaatgtggcaaagcctttaaccagtcctcacaccttaccagacataagataattcatactggagagaagccctacaaatgtgaagaatgtggcaaagcctttaggcagtcctcacaccttactacacataagataattcatactggagagaaaccctacaaatgtgaagaatgtggcaaagcttttaacaagtcctcacaccttactagacataagagcattcatactggagaaaaaccctaccagtgtgaaaaatgtggcaaagcttctaaccaatcctcaaaccttactgaacataagaatattcatactgaagagaaaccatacaaatgtgaagaatgtgggaaagcctttaaccagttctcaaaccttactacacataaaagaattcatactggagagaaaccctacaaatgtgaagaatgtggcaaagcttttaaccagtcctcaatccttactacacataagagaattcatactggagagaaatcctacaaatgtgaagaatgtggcaaagctttctatcgatcctcaaaacttactgaacataagaaaattcatactggagagaaaccctacacatgtgaagaatgtggcaaagcctttaaccactcctcacaccttgctacacataaggtaattcatactggagagaaaccctaccaatgtgaagaatgtggtaaagcctttaaccagtcctcacaccttactagacataagagaattcatactggagagaaaccctaccaatgtgaaaaatgtggcaaagcttttaaccagtcctcaaaccttactggacataagaaaattcatactggtgagaaactctacaaacctaaaagatgtaacagtgattttgaaaacacttcaaagttttctaaacataaaagaaattatgctggtgagaaatcttagaaatgtgaagaatgtaacaaaacctttaaaagttgtcacacttgattgtgcataagataattcatactaaaaaaaaacctataagtgtgaagaatgtggcaaaacttttaaccaatgctcacaccttattgcacaggaaagcatttgtactagaaaaaaatttcaaatatacagaatgtgaaaaagccattaatatctgttcacatcttactcaacatcagagatttcatacttaataaaagcattatacatgc

SEQ ID NO: 727 - DNA, 2249 bp, Homo sapiens
agaccgggaggggacctggatcatggctgccgcgccgccgctacgggaccgcctgagctttctacaccggctcccgattctcctgaaggggacgtccgatgatgatgtcccgtgtccgggctacctgtttgaagagattgctaaaatctcccacgagtctccgggcagcagccagtgcctgctggagtacctcctgagccgcctgcacagcagctccggccacgggaagctcaaggtgctgaagatcctgctctatctgtgcagccacggctcctccttcttcctgctcatcctcaaacgcaactctgccttcatccaggaagctgcagcttttgcagggcccccagatcctctgcacgggaacagcttgtaccagaaggttcgcgcggccgcgcaggacttggggagcaccctgttctcggacaccgtgttgccgctggctccctcccagcctctggggaccccgcctgccacaggcatgggctcccaggccaggccgcacagcaccctccagggtttcggctacagcaaggaacacggccgcacggctgtgaggcatcagcctgggcaggccggagggggctgggatgagctggacagcggccccagctctcagaattcctcccagaacagtgacctgagcagggtctcggactcgggcagtcattccggcagcgacagccattcaggggccagccgggagccgggtgacctggcagaaagggtcgaggtggtggccctgagtgactgtcagcaggagttgagcttggtgaggactgtgactcggggaccacgcgccttcctgagccgcgaggaggcacagcacttcatcaaagcgtgtggactgctcaactgtgaggccgtgctgcagctgctgacctgccacctgcgtgggaccagtgaatgcacgcagctgagggcgctgtgtgccatcgcctccctggggagcagcgacctcctcccccaggagcacatcctcctccgcacccggccgtggctgcaggagctcagcatgggcagcccgggacctgtgaccaacaaggccaccaagatcctgaggcactttgaggcctcctgtgggcagctgtcccctgcccggggcacctcagctgagcctggccccacagccgccctcccaggcccatctgacctgctgaccgacgctgtgcctctccctgggagccaggtcttcctgcagcctctgagttcaaccccggtctcgtcccggagccctgctccctcatctgggatgccgtccagccctgtgcccaccccacccccagatgcctcccccattccagcccccggagaccccagcgaggccgaggccagactggcagaaagcaggcggtggagacctgaacggatcccagggggcacggacagcccaaagagaggccccagcagctgtgcgtggagccgcgactccttgtttgctggcatggagctggtggcctgtccccgcctggtgggggctggggctgctgcgggagagtcctgtcctgatgctccccgcgccccccaaacatcgtcccagaggacagcagccaaagagcctcctggctcagagccgtcagctttcgcgttcctgaacgcctgacccgatggcctggccctggagtcttcagcttcagctgctgtctggggcggtctgtgcttcctgagcagcctcaaccgtagctgctacagtctccaggcagcttgacttgagaggacgaccctagggctacctcagtttcccccatctcctctgccagaggctctggctatttggacttgaatccctacgagggatggcaggtggcagggcttcagaaatgtcgatctcagggctctcagggggcagtccctgcctgtcttgccctcagacatgaggtttcttgtatgaatgcggaagcgactaccaggttccttatttcattttgatctcagctccctccttccccaggaggtcatgagcagcaacaagccactgctcccccgtcccatcggggtgggctaggtgctgaggctgggtttggtgcatgtgggttgagggtgtcttgtccgggctgccttgtgctgtctggcctgaggccatttcaagtctcagatccctacgtgatccttccctggctctcacctgctcctttaggctgtaattgcttcctacacacgaagcctctgattggagcctctggtccatctcagaaaaaccttccaagagcgctggggtttatgctttctgaataaacactactgtttacatg

SEQ ID NO: 728 - DNA, 2072 bp, Homo sapiens
acattccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttggacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattgggcacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaagtagaagacatctctaatggaatcatgggggaaacgggttggaatttgtagccatggaatatatattagatgtaaagaattttctgcaataaaagaaactagacttgtt

SEQ ID NO: 729 - DNA, 1688 bp, Homo sapiens
agccggggagccggagccccgggtccccacgacctgagccggctctcccatcagcggcctgaggacctggcgtccgcctcctccctccccttgaggctggagcgtggacgcggtgggggagggtggggcgggggcagctttcgagaattacgaggacaggaggcagaggccctccccatccgcattattggaggagagagagcctccctctctgcaccctgcaattcccacccctccgtatttatttccctggtcccgccgacagtccctccttgtctgtctccgggattcaggcatccctccctgacatggagagtaacctgtctggcctggtgcctgctgccgggctggtgcctgcgctgccacctgctgtgaccctggggctgacagctgcctacaccaccctgtatgccctgctcttcttctccgtctatgcccagctctggctggtgcttctgtatgggcacaagcgtctcagctatcagacggtgttcctggccctctgtctgctctgggccgccttgcgtaccaccctcttctccttctacttccgagatactccccgcgccaaccgcctggggcccttgcccttctggcttctctactgctgccccgtctgcctgcagttcttcaccttgacgcttatgaacctctactttgcccaggtggtgttcaaggccaaggtgaagcgtcggccggagatgagccgaggcttgctcgctgtccgaggggcctttgtgggggcctcgctgctctttctgctggtgaacgtgctgtgtgctgtgctctcccatcggcgccgggcacagccctgggccctgctgcttgtccgcgtcctggtgagcgactccctgttcgtcatctgcgcgctgtctcttgctgcctgcctctgcctcgtcgccaggcgggcgccctccactagcatctacctggaggccaaggggaccagtgtgtgccaggcggccgcgatgggtggcgccatggtcctgctctatgccagccgggcctgctacaacctgacagcactggccttggccccccagagccggctggacaccttcgattacggctggtacaatgtgtctgaccaggcggacctggtgaatgacctggggaacaaaggctacctggtatttggcctcatcctcttcgtgtgggagctactgcccaccaccctgctggtgggcttcttccgggtgcaccggcccccacaggacctgagcaccagccacatcctcaatgggcaggtctttgcctctcggtcctacttctttgaccgggctgggcactgtgaagatgagggctgctcctgggagcacagccggggtgagagcaccaggtgccaggaccaggcggccaccaccacagtctctactccaccccacagacgtgatccccctccctcccccacagaatacccaggccccagtccccctcaccctaggcccctgtgccaagtttgtctgccgcttcttgcccaggatcctgggggtcgtggctaccccctcctctggccggctccttgctgctcctgtcatagtgagcttgtgccgtccccctaggatggggggcatggccctggctgccagatgcccacagcaccctggcatgacctgccacctctgcttccacaccggagccagctacctctcctgtgcctgccactcaataaacagtgtctgcgcccc

SEQ ID NO: 730 - DNA, 2507 bp, Homo sapiens
agccgggagcggcgcggcagcggctgagatcacgtggtgcgccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaatgtgagtgctgctaacttgtccatggcagaagtccttgctaaaaaagaagagctagcagatcgtctagaaaaggccaatgaagaagccattgctagtgctattgctgaagaagaacggttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacaggggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattg

SEQ ID NO: 731 - DNA, 2764 bp, Homo sapiens
gctatcattttaggcttaactaccaccatctcctcgcgggcagtgggggcaaccgcgaagacagaatttcacaaactttcagctccagcagtttcaaggaaatgtcaaatgacaagatggaagaccgagtgtcaagagctaagacaacaaaaaggcccccaaaatttgttttcaagaaaaccaatgaaaaaagcaagcaatcagaacgtgaagtccaggatcatggatgtgcttatcttcacagtcactgccgggtcctgaagttctcctctggcccagtgccagctgcgaagccctctgccaaagggccagaggaggccggtgatatagagctctgattacccacccgtcagggcaccgctgaaggtcactgaatacttactgtgcacccgaaaaataaatcctgcgagttcacgcccgcgtagttcgccccctgattttgagcgactcctttcgcatgggatctacaaaaccgaactgccttaaagacctctttcacacggacgtgaagtcacagaactgacaaaatcccatcctgtcaaagtgcacgggtctttgaaatctaacacaaaaagccatagaaagattctctaaacaccctgtactaagaggaacacggacagggcactgcgttctgaagtagaggccagggcactggcccttagacacgtctcgctgtcaccgggctaacaacattggcaagggcggcggcagcagcactgatatttgcagcccccaagggctctggcgaaaccccctctattactctgtaccctgcctgcttccaagatgaacctgttgctgggaaagaacaggctaaattagaaaagggagtattttgtcaaagttgaaggtgagtgatagcctgcccgcctcaaataggatgggaaaaactaaggatattggggatgatgacactgtcgcctccgaattctggtccggggctttctcccagccctcaagtgtccccacgcggccgcggaccccgaacagggacagctggagacgggcttgggcagcgcgcggcctgcacccgcggccatccatcttgcagcccggcccggccaggctatcccgggcaagggctgggggaactcgctgcccccagcgccgccacggccgggcgacattctgcgccctgggaagggggataggggtgcggcgcggccccggtccccggcccgcccggatccccggcctcaccttgacgtggaagcggatgagcgccaggcggatgcagtgggccatgcagacgggcggcaggaaccagacctttggcggcggggtgcccttgttctggacatggctgacgatctgctgtgccgtctggcgctcgttgccctgccgcttgacccactcgtgcagccgggccttctcgagcgcgccgttgaagaagacgaagagctcgatgttgccgccgaagcaggccttggccagcgccgccagaaacctctgtagaggagcaggatgcaaccgacaggctgtggccggacagctgctgcccagcacatggagcctgcacgcgcacggtttggccaaagaagcccccatactcccggtgaaaaagatttccagaagctgttctgtcaataacaaagtctcagagaaaaccacaaaaccaccaacactaagatcattcttgagtccaatttgaaaaactagggtcaagttctgcagaggcattgaaaggacaagaaaccaccctgatacccatcgtgtgagggaaaatgctctattcaccattcctcagcttctgcttctggtttcagagttctctctatattggagggtgttttaaagctagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctactggggatatggagatgaagaaaacataacccttcttcaaggagcccaacctaccaaggtagacagacatatagacaaatagatacttgcatagaaaaaaagaggaaaaggggatcagtgtgacctgtgtaactaagtaccctataaaccctcctgcaacagatcatattgccctttatagtggggatggtaatcccatctgaattccacaggtactttgcagtcataccacacccatgtgtctgtcggtcctgactgtaccatttataaacagcttcactttcagcagttctcagccctcttaagctagggtcattgtcagtagggatactgcttcataagcaccagcagaacaccaaaggagaccatatgggtgaaagcaaccagcactgccctggcgcttcataggttcttagagtttttatcttttactttcagtctaacacagcactgcctgctttttgtttttgttgcttggtttgtttttttcttaccgtgttcaccaaacttgtgtccaaatagctttgggctgatgcaaaaatatctatgtggaagagaagagttgttctcatggagggccttcagatgagtgctatagactctctaggcaactccaagaggcttctcaagcagggtgggcagtgagagctgctatggaatcaatggacaaactgacagggactgctttgaaagacagtactcagttgagtatatatattctctcttaagggctaaaagtttataatcatcccttaaacactctgtgatgggatcttcaggatcatcttttgaagtaaactatattttacaatgtg

SEQ ID NO: 732 - DNA, 2343 bp, Homo sapiens
acccatgctgactctggagcgggccgggtggcgctgcccatccccggatccttcgtagatggagtcttgcttagtcgcccaagctggagtagtgtggctcgatctcagctctgcaacctctgcctcccagggttcaagcaattctcctgcctcagtttccagagtagctggaattatagtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatggtctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacag

SEQ ID NO: 733 - DNA, 2324 bp, Homo sapiens
atttttggacaggaaagttccaggcttcagctcccagaaaccaccttccttcatgtggagggacgcagcctcataagggctggagtgctgtggtgccatcatggttcactgcagccttgacctccagggctcaaatgatcctcccatctcggcctcccaaagtgctgggattacagatgtgagccactgcacctggcaagaaacttttccattaaaacacaatgctccgaaaggtttgttgcaggtaacgcgttccttgtattcagcaagggcggtatatctgcagtgtcttcttcctgggcctacactctgtgaaggtcaatctcatactcaacccagtgtgctgagaaacaggagagtgactgatacaaacaacttatttgagcatatttacctgaaacagtatttaaaaaactgagcatatcttatgacaagaatctcatgctttaaaactctaaactatatccctatgcaaattactgacaatatacgttttaacatcagcattgtacttttaaccttaggtctagggttaccaagtgctgtggcactgctttgataccttatagtttccagttctagtttacaaacataacatgcctttatagttctcagcgctccttaaatatgtggattggaattctaattcctttaaatttcatgttgagttctcagtttctctgcagctactatagctgctctgagttgatgtaattcaaagtctctttaaaagaagctagggcatttctctgttatgcaattccttctgttgcattggagaaacaccgagtaatgcagccacgttgggaaatgctgtcattcccaaatctaagtatcctttaatgggacctactgaaaaaaaaagaagaagaagaagaaatgccagtacctttcttccactaaattgctttggacacatgctgctgctgttgttgaactcactgcttttgtatacgaataataagtttccaagctgtggggaggaagacccccctgatgacttacaacccctctcagatcccatgaccctactgcctccaccatcagatcccacagcagcggacttcggggatgccgtgagatccaggggtgcctgggaacggtttgcctctccctctgtgccctgcccagccctgcggcccacgcgtgtgcgtgtagcacagtttgttcttctaaggacacgttccagaattactggagtctcctgaatgctgagatgaatagactgggtgagctttaggtgctgcacctgtccttcaaaatgaaactgaacggaggcccgcagagtctccccgggaaatagggactgaggatgcgttccatctgggttatgctttcatccctgcagcccctggtctgcccccctgtcctcagaaacagctcagtcctttcggtgaaatcggtgaaatcggtggttctcatcttctgtttcttgaacacacgtcttgttcccacccatcggttatggttggagaggcatttcaagaaaacacctgttagggctttttgtgtgtgttaagccgctgtgctggtgtgctttagaatcatccggaaggtttgttaaaaccagagtgctgggtctcttccctggagtttctgagtgtgcaggtctggaatagagctcaagatctgcgtttctaacatgttctgagctgctggtcccagtactacgctcagccaaccagccctccagacttatatgcaatgagccctgtggctttacacggtatcttgatgaagaaaatgttatgtaaatcatgctctaaaacaacgattggatttcagtgcaattacagaaaatcttttcatcaagatgtctatgaatgaaatactgattttaacaggctgcccattttcaacagcataaaatcacgcattcaaaaccatgatgagccccttaaattttaggattgagtttcacttcctcactgacattttgtgaaaaataacacccgcaagaggcctaaacagggcgatcggaaccaagaaaacttaaggaagtatttgcacgttttgatgtgtttatttatttgggatgcgcggaggctctgaatggagaaagtcgtcgatgcctgcactggtcttggcctgttctttatgttccgcgcggtgacagctttaagatgaaggaggaacataaagggtttcatcacaggaaatagaactattgctttattcaaacatttaaaaaataaatacaataaatcagggatttttcccctttccgagtattaaatacagatgtactgtatgcatatgaaatttttgattaaaatgtctttcaccagtctgtctctttaattaaataaagcctgtttggtatt

SEQ ID NO: 734 - DNA, 2274 bp, Homo sapiens
atcttccgccagagaatcccggctcctgctgcaatggagtggctgctctggaagctctggcgttggggtcttcatccctgcagtcttttccagctattgtgtagagcattttgggcaagagaatctaggaccaagcccaagccacaccggttctctgcttaatccactccattcgactgttctcccagctatgcttccagagtgctctgtgcatttccacgatcaacaaacgatgaataaatctctggaaaaggaccaagaacatcttaaagaaatacttcatgatggaagtgatgttttaagtgaaatttcatcaaggagaagtttttccagaaagtcttttgacctcactgacctgtctaggatccctgagttccaggtccagcgagagactccacgcagaggagggctgtcattctttcctaagcatctcggggatcccagagcctgcccaggaccagcaggacctcgcactccggggaaatgttgggtgtccagtgcaagctaagtgctcggcccacagccgcgtcggcctgcggggcgctcaccagccctccggatcaccagcctgggtcacttcatcctggagcaactcagacgaattctgtctcccagggtatgagcgaattacccagagagcaatgagctgagactcaggtgattgtccgttattcatccacatggttcacagatgacatatccccacgttgagcctgcaacagagcgcgaggtggatagtcccgtccacacaggagtcacactcaggacgactgaaggatggtttcgggttccacgtttgtttgccttctgcaagggggcctgttgctcacgtgtctccagccctcgaaagtgtgaccatgttgactgtttgtttcccgagccctatagggacacagaaacctccagagaggtgtggaaaagcagcctcgtgtctttgctctcctttccagtttccaagacacagcttgaaagagagctggggagaccgggatggagagatagaaacagagagagagagaagagtaggaggttgagggggaagtagagagagagaaggaggaaggagagggagagagaggagcgagaggtggagggggaagtaaagaaatggagagggtgagggagttatagagctgtagagcgagaaagacagagccttagagagggaggctctgctcaggtagacagggacactttgagtaggccggggtggggtggagggtgcttgggccgggctagaacaggggttcagggccccccatgagggaaaaccaacgcggcactgagatgtgtttttccttggattggttggttgctttgtgggtgcgtttcataggacccttcctttgctggctgtagggaaaagaaagcgagatcagactgttactgtgtctatgtagaaagggaagacataagagactccattttgaaaaagacctgtactttaaacaattgctttgctgagatgtttttaatttgtagctttgccccagccactttgacccaacctggagctcacaaaaatatgcgttgtatggaatcaacgtttaagggatctagggctgtgcagggcgtgccttgctaacaaaatgtttacaagcagtgtacttggtaaaagtcatcgccattctttagtctcaataaaccaggggcacaatgcactgttgaaagccgcagggacctctgtccttgaaagcggggtattgtccaaggtttctccccatgtgatagtctgaaatatgccctcgtgggatgagaaagacctgactgtcccccagcccgacacctataaagggtctgtgctgaggtggattcgtaaaagaggaaagcctcttgcagttgagatagaggaagtccactgtctcctgcctgcccctggggactgaatgtcttggtataaaacccgattgtacatttgttgaattctgagataggagaaaaaccgccctatggtgggaggtgagacatgtttgcagtaatgctgccttgttattctttactccactgaggtgtttgggagaaacataaatctggcctacgtgcacatctgggcatagtatcttcccttgaacttaattatgacatagattcctttgctcacatgttttttgctgaccttctgcttattatcaccctgctctcctactacattcctttttgctgaaataatgaaaataataatcagtaaaaactgagggaactcagaggccagcgcctgtgcaggtccttggtgtgctgagtgttggtcccctgggcccactgttgtttctctat

SEQ ID NO: 735 - DNA, 2378 bp, Homo sapiens
gattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctgggctttcttaccaatccccaattttcttttgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtagcaagaactggcctattggcatcgtattcctggcattgagctgtattgaccctgaatgtgtcctcctgaggtttttgagggtgacctgggagaaagggtctgaaaaagcattgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgaagctcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcatacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttg

SEQ ID NO: 736 - DNA, 1962 bp, Homo sapiens
gttctgatgctgatcttcagtaactctgctgcctctgcctgcctattcagcatttgcctgttaacaggaagctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccattatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcc

SEQ ID NO: 737 - DNA, 2847 bp, Homo sapiens
ttttttggttaatgttgggtgtgtttctgcggtttgtgaggtgagaggcgctggagctatgggtccgaaccgcggtgtctgaacccagaaggtgaagagtccttcttgctgcacagaggcagatcttaggccccgtaacggcgcccgccgctcccggcagtgctttccccgcgtactcgggatggcggcggccgcgctgaggctcccggctcaggcatcatctggctgcaaagaagagaacacactgtgtttgagggaggaggaaggaggatcagagtttaaactcctgccataatgcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggcccactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagcatcagcgagttcacactgggaaaagaccttatgaatgtggaggatgtgggaaatcttttagtcataagggcagccttgttcagcatcagcgagttcatactggagaaagaccttatgagtgtggagaatgtgggaaatcttttagtcaaaatggtactctcattaaacatcaacgagttcacactggagaaagaccttatgagtgtgaagaatgtgggaaatgttttactcagaagggcaatctcattcaacatcaacgaggtcacactagtgaaagaccttatgagtgtgaagaatgtggaaaatgttttagtcaaaagggcaccctaactgaacatcatcgagttcacactagagaacgaccttatgagtgtggagaatgtgggaaatcttttagtcgaaagggacaccttaggaaccatcagcgaggtcacactggagaaagaccttacgagtgtggagaatgtgggaaatcttttagtcgaaagggcaacctcattcagcatcagcgaagccacactggagaaaggccttatgagtgtagagagtgtaggaaattatttaggggcaagtcccacctcattgaacaccagagagttcacactggagaaaggccatatgaatgtaatgaatgtgggaaatcatttcaagacagctctgggtttcgtgttcatcagagagttcacactggagaaaaaccgtttgagtgtagtgaatgtgggaagtcatttcctcaaagctgttccctccttcggcatcggagagttcatactggagaaaggccttatgaatgtggagaatgtggaaagtcatttcatcagagctcttccctccttcgacatcagaaaactcacactgcagaaagaccttatgagtgcagagaatgtgggaaattcttctccagtctccttgaacacaggagagttcacactggagaaaggccttatgaatgcagggaatgtggaaaaacatttactcgaaggtctgcgcattttaaacatcagagacttcatactcgaggaaagccttacgagtgcagcgaatgtgggaaatcctttgctgaaaccttcagtcttactgaacacaggagagtacacactggagaaaggccttatgagtgcagtgaatgtggaaaatcatttcatcgaagctcttctctccttcgacatcagagagttcacacagaaagaagtccttacaagtgaaaagaaatttgggaaattctttagctaaacctctgtgcatcttcttgatcagagggttcttactggatcaggaccttatgagtgtgacaaacgtgggatattctttatgcagaagtcttgttttattacatacagaagagctcccactgcagaagggcctcttgagtgcgatgaatgtgagaaagccttctgccttctgtcattggataacagattgttctcataaggaaaacactgtacacgtacaggaaatattatttcttgtaaaacataacactggaggagatgccttatgacggagccatctgcctaaattgacataccttcagcatctgcataaactcaattatgttggagctgtgtggcatttttcaccctgccgggttcccttgccagacatgatgtcggttatctggcaaaagccattttatgtcggccacgaggcaggtgttcactgtgcatcattcattcaccccatgatgttctggaagtaaaccttggttgtctttcgttggccagagg

SEQ ID NO: 738 - DNA, 1955 bp, Homo sapiens
agtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaagaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctc

SEQ ID NO: 739 - DNA, 2651 bp, Homo sapiens
ttagatctcatgagaactcactatcacaagaacagcaagggggaagtccacccccatgattcaatcacctcctaccaggcccctcccctgacacgtgaggattacaattcaagatgaaatttggttggggacacagagccaaaccatatcattctatccctgacccctcccaaatctcatgtccttctcacatttcaaaaccaatcatgccctcccaacagtcccccaaagtcttaactcattccagcattacctcaaaagtgcaattccaaagtctcatctgagctaagacaagtcccttccacctatgagcctgtaaaatcagaaacaagttagttacttccaagatacaatgggagtacaagcattgggtaaatgctgccattccaaaagggagaaattggcaaaaagaaaagggctagaggacccacgcaagtccaaaacccaacagggcagtcattaaatcttaaagctccaaaataatctcctttgaatccatgtctcatatatatggcatgctgatgcaaggggtgggctctcacagccttgggcagctctgccactgtggctctgcagggtactgcctcagcagctgctttcatggactggcattgagtggctgcagctttttcagatgcaaggtgaaagttgtcagtggaactagcattccggggtctggaggatggtggccctcttttcacagctccactaggcagtgccccagtggggactctgtatgggggctccaaccccacatttcccctctgcactgctttactagaggttctccatgagggctttgcccctgcaacagacttctgcctggacattcaggcatttccatacatcctcagaaatctaggtggaggctcccaaacttttgccttctgtgcacacacaggcccaacaccatgtggaagccaccaaggcttgggacttgtaccctctgaagcaatggcctgagctgtatgttggccccttttagctacaactggagccagagaggctgggatacagggtgccatgtccccaggctgcacagagcagaggggcccataaaaccatttttccctcctagtcctccaggcctatggtgggaggggctgccacaaaggtctttaacatgccctggagacatttccccattgtcttggctattaacatttggctcctctgtgcaaatttctataacctacttaaatctctcccccaaaaatgggtttttcttttctaccacatggtcaggctgcaaattttccaaacttgtatgctttgcttcccatttaaatataagttacaatttcagaacatctctttgttcatgcatatgagcatacacttttagaagcagccaatcacatcctgaatgctttgctgcttagaaatttcttccacctgataccctaaatcatttcccttgagttaaagttttagagatctcgagggcaggggcaaaatgcagcctgtctctttgctaaagcatagcaagaatgacttttactccacttcccaataagttctttatctccatctgagaccacttcagcctggacctcattgttcacatcactgtcaccattttggtcaaaccatttaacaaatctctatgaggttccaaacgttcccacatctttctgtcttcttttgagccctccaaactgttccaacctctgttcgttatccagttccaaagtcacttccacatcttcaggtatctttatagcagtgcccaaatcctagtatcaattttctgtattagtccattttcacactgctacaaagaactgagactgggtaatttatgaagaaaagaggtttaattgactcacagttttgcaggcttaacaggaagcatgactgggaggccccaggaaacttacaatcatggcagaaggtgaaagggaagcaagacacatcttcccatccatggtggaacaggagagagagaagggggaagtgccacacatttttaaaccatcagatctcatgaaaactcactcactatcacaagaacagcaaggggaattccacccccatgattcagtcacctcccaccagggccctcccccagtatgtggggattacaatttgtgatgagatttgggtggggacacagagccaaaccatattaatgatattagagccctcatgatctaatcacctcttacggttcccacttcttaacacagttgcattgaggattaactttccaacacatgaatatcgtgggacacgttcaaaccatagtggatcttgtattttccaatgactacctactctccacccaaatgttagaatatccccccatcactttctattattgtacactaccttttttctctacactacttctcaatccttatgatttattattactgtttttgttattgttttacttgtttatgcatgcttgtttcccctgggcacatgcctggcatgttttaggcaccagtacaagtgtgttgaatagatagatggatgaatctctaatgttttccaactatagcaccctaattgagactggaaagattctgtcaagaataattcttgggtcttgatttcaccaaacagtagtattgacacagatacttataaccctctggaaacagaataggacaaaataataaaatatttttttctgcttttgtgtc

SEQ ID NO: 740 - DNA, 2057 bp, Homo sapiens
ctcttttgactttcagaccagttgttaaattgcccgcctccgccaagggccccctgggtgtgtaatgtccagtccccagccaggctctgtcccctgccatacctagactgtgtgtttcatatttttttggaaagagaagtgaacatccagccccaatcatggtatcattcggtctgtcctcagcgtggcttggacggggcctgtgtcagagtggtcagtgctgacccctggggctcttgggcagaaagatgaggagacagaggtccagggtgggttacatagcacatccagggctgagcaagaaataattcagaggtcctaccctctgtctagggacccccctcccaagcctggccttggccttggcacaaagtcctccttgataggagatcccactcactcctggaggctgcccctgaggcttggcccagctctaggagcagtccccagggtcagggagcccctggtgtggaaagaggccccaaggtagtaaaccctgcccctgttactgtgctccagagacctcctaagggaagggacagttcctggaaggccctccagctggatgctggggatcagcgataggtgaggggacacagtgtaggagctccccatgtagaaaagggaatgtggggagggcgttaggagcttgcaggcattaggactgtcctgagcaaggtctgcagcccccagctctgctcaccccgaatcctgccccttgtttccacacctaccattcctcctctcctgatccccagcatccagctgaggtccaaggtctttgtcctagaatcagagtggggaggggacagcctggggctgcccagagactgtgggtggagctgcctgctgcactcagcagtgcggtcagagaagggcttttggtcttgaagtccaggtaccatccccccttagcatacagggggaagggcctgagaggaatgtaaggaaaccagcccagatcagtcccaaggccagagtcctttgtcctacatctccctgaaccagagtgtgccctgcccctcatgctcagacctctcccaccccaaaccctctcccgggactcagtctccctggccactgcgtatcaggcttctggggaaagcatccatcacagaacctccccttccctgccacgcaccttccttggccagctccattctggcctcctccaccacctgccttgtgaccacatctcccaccacgtccccagatctcaagaacgcagctcagcttctccttcgagcttgactctgagagggaaagtgacggaaaccaagtcagatgagatgactgccatgtacactgcagtcaagggcagggaggggaggaatgacacaaatggcagggagctgctgggggactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcagggggctgtagtgtgtggtcagcactgagggctcctctacgaggcctcaagcccaggtgactctgtgaggtctgcagagggagaaaagaacccacaagggaagaggtggaggtcaggcacggtggctcacacttgtaatcccagcactttgggaggccgaggtgggtagatacctgaagtcaggagttcgagactagcctggccaatatggtaaaaccccgtgtctattaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcac

SEQ ID NO: 741 - DNA, 2814 bp, Homo sapiens
acaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggattaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgaggaccccttgttgaaatgggacagttggcagcggctctgatgagcccgagaagaggcctgcccttgggtgcggagtctccctccgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaagtcggttctctttcatagcaacacgtattgtctgacattcagccagcttttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtgacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagtt

SEQ ID NO: 742 - DNA, 1890 bp, Homo sapiens
tttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaatttttatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcatgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttg

SEQ ID NO: 743 - DNA, 1844 bp, Homo sapiens
tggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaagatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagagtctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggagttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccatcgctaaccccactaaaacactcaccaagacctcaacccctgacccccatgcctcaggatactcctcaatagccatcgctgtagtatatccaaagacaaccatcattccccc

SEQ ID NO: 744 - DNA, 2477 bp, Homo sapiens
gcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaggaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgttccttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagcccccagactgtcaggcaagcctgggttctacccctaatgcaaatacccaccagggagatgtctagaggcagactcctgagcgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagaggagccccgggcttggcggctctagccccagcgccaaaggagacccgccccagggccgggctttgcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcagtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaat

SEQ ID NO: 745 - DNA, 2858 bp, Homo sapiens
aaaaacaccttttaaagcaggtgctggggacacttctcagggccaactgccgagaccacacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaaatgtgctacatctcagccttggtcttgtcctgcttactcaccttcctggtcctgatacgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcacatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaggctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgag

SEQ ID NO: 746 - DNA, 2547 bp, Homo sapiens
agctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgc

SEQ ID NO: 747 - DNA, 2406 bp, Homo sapiens
agcgcagtatggcgggcggggcccgggaggtgctcacactgcagttgggacattttgccggtttcgtgggcgcgcactggtggaaccagcaggtgaggtcagccggcagctgcccccgaggagcccttcgggatctacagtcccgacgttcagccggcctgcctcgtcctctctgcttccccaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccacagactaatggtggttttggctttgttctggcagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcgtgagttctcgaaaatggtgggaaacctaagaaaggaggagggctgtattcactgatccttagtaacatgttaacatttatgaagcactat

SEQ ID NO: 748 - DNA, 2441 bp, Homo sapiens
aactttgcctctcctttacgccaaatacgtgtccttatatctgaatctacaccactattatagattcaccttctttgagaagtccctatttgaagagaggaaaattcaggctacttgtaaccctcttattctttttagacggagttttccctcttgttgcccaggctagagtgcaatggcgcgatctcggctcaccgcaacctccgcctcccgggttcaagcgactctcctgcctcagcctcccgagtagctggaattacaggcatgcgccaccactcccggctaattttgtatttttagtagagacggggtttctccatattggtcaggctggtctcaaacccccggcctcagcctcaggtgatccgcccgcctcggcctcccaaactggtggggttacaggtgtgagccacggaacgcggctcctcttccttctggatatggctgtctcagatggccagaggcctcggaaaggcttccggtttcccggcaggcccgagtggggctgaacttccggcctcaggacgcaggcgcgggccgctcatttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtccccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcccgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagcc

SEQ ID NO: 749 - DNA, 1709 bp, Homo sapiens
ggctcccggaggcccgcgccgccctcgccctgcacgcctagcgttgtcccgcggccaggcccggccggagcggcggcgcctggatgtggacctggctgcggggagacgggcgccggccccaaagcgactttcggtcctcgacgcgccccgccccacccctgcgatgaagagggcgtctgctggagagagtgccctgtcggtgcagaggaccagcctccgccaccccccgacgcctgccatgtacaagtttaggccggctcacgggtcctaaggcaccttctgtggatgaggcgagcaggttccaggccccgattcccttatcctgggggacgacagcatccatagcctggactttgtgtcgagccgagcctggacttccctgactatgggcccgggggcctgcacgcagcctacctgccatccccaccgctcagcgcctctgatgccttctcattgctttgtgctccctgagcctcaaggcctcaagccggcagggcggggactacgtggccctgcagcccctgtgctccgagggtgggcctcccatgccccaccgtagcatctttgcccccccatgcactgcccaaccacaatcgcagcctgtcctacaataatgtgctcaaccctggctcgcctggtggccacgcctgcctcgcccatccagcagttggcgtggccggataccactcaccctacctgcaccctggggcaacgggcgacccaccatggcccctgccccacagcttcagtcccgtgctgggcccccggccccaggagccctcgcctgtgctctacgacatcctgtccaggaccatcatggcatccatccaggagcgcaaggacagggaggagcgtgagtgcctgctgcgctcccaggccgactcactcttcggcgactcaggcgtctatgatgctcccagctcctacagcctgcagcaggccagtgtgctgtctgagggcttctgaggtcctacgctgtgctacagctctacagatgaccttgtggccaggcccggcttcggcggcgcctgcaaccctgtcctgcagacatcattgtcctcgctttccagctccgtgagccgtgcactgcggacgtcgtcctcctccctgcaggctgatcagaaccccttccgagaccctgctcagctggcccagcccctgcccctgtgttacctgagaatctccaactggatgtcctccatctggtccagcacgccccagatgtccttcttgaggttctgggggccagaggagcccttcagggtttctcgctctctgctcctcgctggacagaaaagatcctggcagcctcgccctccaccctggatcccctccccactaccctctgcccctgggactgggtggggaagctgaggcaggaagccctttagtcacttgccgaaggccacgctgttacccatgggaccggttttgggcggccgaagagcactcatggggccggattcacgccccgggcccgttccctcctgctctctggtgctcctcacgccattggccccactgcctctcactgcccgtgagtccctgtgcccgtgtcctccttcttgaacccctcagccctcagttaaccctcagaaagctggctcggagaagtccttgtgtggtatctgggaggcagagtttgccgtgagccgagattgtgccactgcacgcactccagcctgggcgacagagcgagaccccatctc

SEQ ID NO: 750 - DNA, 1797 bp, Homo sapiens
gggtttgatcgccagcgcagcctcgccctgcccagacagctgggccctaaggggatagccagcgcctttagacttatcttaaatcgggcatctgcatcaacacttatttctggggtcctccatggaaagcagctcccgaaacaacacccgcccggtccgccctccgctgcactggaaaaccgcccctggacgtttctgccgcagtgtccccctcacggagttccgtttgtctgcttggtcggttgttctctggagccccaggacccaggccgcttgtatgtgcctgcggccgcacggccccaacacgcggacttcgagcggtaccgggagacccgcgcggcctcctcggagtggacagtgaagcagcagctgggctaggcagtggggctgggcctgcccatggggacccgtccacgtctccaggacatcagcctgagcctcttcgcagcctcgttttctgttgaccgagttctgcaaggggacgtagaggaaccacagcgttcttgcgcttgagaccgctgtgattttctgacattttggaggcagaaatgcctggggaaaggcccacagatgcaactgtcatccctagtgccaaaagggaacggaaagcgattacccttgacctcaaattggaagtgttacgacgattttgaagcgggtgagaagctcagtcagatcgcaaaggccttagatcttgctatctctacagtggcgaccattcgagatagtaaagaaaaaatcaaagcgagttcacaaatagctactcctctgagagcctctcggttgactcgccatcgaagtgcagtgatggagagcatggagcagctgctgagcttgtggctggaagaccagagccagccaaatgcgaccttgagcgccgccatcgttcaggagaaggctgagtttgatgacttacagcgtgaacatggcgaaggttctcaaacggagaggtttcatgcaagtcaagggtggcttgtgagattcaaggagtgccactatttgccccacttcaagatgaacagcgcagctcccagcaacaaggacatgtacacagaaatgctgaaaagcatcatcgaagaaggtgagtacaccccccaggtgtctttaacgtagatgagacgagacttgattggaagagaatgcccaaaggaacgtttatttccgaggaagagaatgctgagccagggttgaagtcatccaaagatcgcttgatgctgctgcttggtggcagtgcagctggggactttaagttgaagcccttactggtgtaccgctcagaaacccgcaaggctctgaagggttcttgaagcccagtttgcccgtgatttggcgctccaacagaaaggcttgggtgaccaggagcatctttcatgaatggttcacttactttttttgccgttgaaaaatacagtgcccaaaataatctcaccaacaatgcactgctcatactagacagtgcgtcatgccactctgtaaatatgagcgacctttctgataactaagagtagaataccttcaggccaggcgcggtggctcacgcctgtaatcccagcactttgggaggccgagacgggcggatcacctgaggtcaggagttcgagaccagcctcaacatggagaaaccccgtctctactaaaaatacaaatttagccgggcgtggtggtgcaggcctgtaatcccagctactcgggaggctaaagcaggagaattgcttgaacctgggaggcggaggttgtggtgagccgagatcgcgccattgcactccatcctggacaacaggagtgaaactccgtctc

SEQ ID NO: 751 - DNA, 2795 bp, Homo sapiens
attttcgattccactctcttccgtttctgtcgctgcagtcgtccgcgggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggcagtcccgtctgaatgtggagagagctgtagttttatctggcttttaaaacatggacctgccggctgggcgcagtggcttacacctgtaatcccagtactttgggaggccgaagtgggtggatcgcttgagggcaggagttcgtgaccagcctggtcaacatggtgaaaccttgtctctactaaaaatacaaaaattagctgggtgtggtggcatgcgcctgtaatcccggctactcgggaggctgaggcagcagaatcacttgaaaccggaaggcagaggttgcagtgagccaagatcgtgcaactgcactccagcctgggcaaaagagcaaaactttgtctcaaaaaaagactcttttcaagttttctaccctctgataagaaaatttggggatatccagtgccatctccaaggactttcaggggatcatagatgcttttctgtgcctatctgctttgaccatgtgaaaaagtgatagtctgcttctctctggtaacttgtctgccacccatctgatagtaagattagccaaggccctttagccctctgtcctttctggttattgactgtccctggttcctaggaagacagagttgttctccagctaaagcgtctcctctctataaagtagttttactattcttttcatagcaggagccaaaatagtagaggaggggagagaggcacctggcactctgcgggcctgcacaggaaaaacagagccaaagacagaatcattgtataagatatttattaaaggagagcctctaagtccacatcctgagcccatgtgagtggacacaggtaggtaaaacggtgggtccagctgctgtcatctgaaagccttcaggagatgaagctatcagtatccagctgaaggctgctgggttctgttccaccaccaccttagcaccagggccctctctggtcccagaggcctcatctctccttgggctttgacaatgtggagcagcacatcagcagggactggtctagaccctccctttcctgtcacttagctggagctaagctccagataacccctaggttcccactggctcctagtagaaatagtttctgtactttagcagaacaggaaggatatttgttcattaaaggtggcttggtcttacagctgggtgcagtggtatatacctgtagtcccagctactcaggaagctgaggtgagaggatctctagagcccaggaattcaagtttaacatgagcagcaacattagcaagaccccgttt

SEQ ID NO: 752 - DNA, 2776 bp, Homo sapiens
aagcgcctggcgcgggcccgaacgtaaatggcgctcctccgcgccgcagccgcagccgcagccgcagccgcagccgccccgctcccttcccgctccgccagctgccgccgtcccgcgctcgcttctcgccccgcggcctggcccgtgcgcctccgaggctggccaggggcaccgaggccgcgggtcccccatcgcccccacccgagccctgatttaccgtccgagagccggcggcacatgggaccccgagaggagaagcgcgcctgccccagtgcgtccccaggcgggggagccccgactcctggagggaccgcgtcctgcccggcccgggaagttcagggctggagaaccccctccccgaccccatttctcttttaacaagagtagggtttgtagctaaccaacgtcctgacagctcagctctgctttccctttaagcattaatatcaaagccctgcctgctaccggtgaagccccgacccgggagggcccgaaagtcccttcagggagaggccgcactgggcctgctcacccaggggctgcccctgcagactctcccgaggggcccagggatattcctcgcgccgcgagtggacgcttccatccaccccatggggagggcctctgcgcgtggctactctgagccctctggaatgccgagatagttgcataatttcagaaaccacggcatggagacggaatgatgcagactcctatccgcgagatacctgctgtaatttcgctgtggttcgtgaggacgcgtcctgggctgccctgagaagcctacgtctccccttcgaggcccgggaagacctccaaccccgctgacaacgctgggccctcagccagacctgccctgcgtgccacgttctgttctaagatcgggctgccgagctgtggcctggaggaaacctggcaggtgtcaccagagctttggggagggtgaggccctgtcggggaagcccagtgggagtcatgaaggagggaacacgtgtggagcccttgtagggggaggggcagccctgcagagatctaagaaaaaattccagaaaaatgagcagcaacctccaaggccaggcatcggtgcaggggacaaggggtcgtagctggaggggcctaggtgaggctgccgggaagggacgatgtggttggtggagtgcacaggcagggacctcactggactttcctgtctgctcggcatggacaggcagcccaggagaaggcagcacgtggccgggtgcagggacgtaccacccccacttccccaggggagctggggtcagacgagtcccaggcactccatcctctgcagcaagtcaggttgtgatttactagggggtggtgaatataatggagagacctctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaatgccagaggcatgggcattaggtccccccggccagcctccgttgccacatgggctatttttgtccatcgcgtgggacaacctagtattgggggaaaactcagtccactctaaagaagcatcggcgttttggatggacgaatgctgcttcatgcgtctccatgtcaatggactattttattcaactcgggtatttatgagtgtctcctctgtgccagccacgtgtgaaagaagaactccaagttactggacaccaggacaaaccaggagtctcgctgtgtcacccaggctggagtgcagtggtgtgatcttggcttgctgcaacctctgcctcccaggttcaagtgattctcctgcctcagcctcccaagtacctgggactgcggatctttagataagcactctttcaaccaaatgccaatcagaaaatctttgaatccacctgtgagctggaagccccgctgtgctttgtgttgtcctgccttttcggaccaatgtaaatctcacatgtactgattgatgcctacatctccttaaaacgtataaaatcaagctgtaacccaaccaccttgggcatgtgttctgaggacctcttgaggctgtgtcactggtcatgatccttaaccttggcaacataaacttctaaactgat

SEQ ID NO: 753 - DNA, 2603 bp, Homo sapiens
agaccccggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggctttgtctgcccatgccgattgacgttgtttacacctgggtgaatggcacagatcttgaactactgaaggaactacagcaggtcagagaacagatggaggaggagcagaaagcaatgagagaaatccttgggaaaaacacaacggaacctactaagaagagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgac

SEQ ID NO: 754 - DNA, 3424 bp, Homo sapiens
ctcctggaggaaaatggcggtcgctggagccgccgaccaagaggcttgggagtctgtacctttcccgaccgggccactggaagttggagcctccgccgagtcgcagacaacgcctccgggagggccttcctgatgcgcttgcctgctccctggtctctctgcatggggaaggagtgttcccagcttgcaaactccagctttgcctgtgagaggaacaagcgtccctgatccagaaggtgttcggatggagatggcgagttctgctggctcctggctctctggctgcctcatccctcttgtcttcctccggctgtctgtgtatgtgtcaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaacccttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgtttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatgataactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgactatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttg

SEQ ID NO: 755 - DNA, 2062 bp, Homo sapiens
gctgggagtcctggtgccgccggctgcacttctgtgtgtctttcaggaagccacagggcagggggcgtctgtgcagagaagcgggggagtgagtagcaggcaggcccagcttgtgtaccagcccagtgacatatatagaaacataaatcaggctagagccggcgcgcccgggcgcgcacctgtgtatggacccgcaggcatgtctgtacactgggtgggcacctgtcttgtgagtggctccgggtgtggctgctcctcggactttcagtttatgtaagatttatctctaggggcctaccttcccccatctccagaggggaacataagaagtttaacggagctgggactgagcagattaagggagtggagcggaggctgggccggagagagtggggactgtgagtgctagtgggtaaggatccatctgtttgccccgtcccccagccagaaaggcattttggaaagactggcgtggcaagcgtcgccctgaaacgtccacagagcccaagaagtgatgatcactgagtgagtggcactgggctgagactggccagtttgttaacaacagggatgctagcagttaggaaggccaggaggaaactcaggatggggaccatctgctcccccaaccccagcgggacaaagacatcatcggaggtctgcaatgccgactggatggcctcgctcccccctcacctccacaacctccccctttccaatctggcaatcccaggctcacatgattcattcagctactgggtggatgaaaagtccccagtggggcctgaccaaacccaagctatcaaacgcctcgccaggatctccttggtgaagaagctaatgaagaagtggtctgtgactcagaacctgacatttcgagaacagctggaagctgggatccgctactttgacctgcgtgtgtcttccaaaccaggggatgccgaccaggagatctacttcatccatgggctttttggcatcaaggtctgggatgggctgatggaaattgactcgtttcttacacagcacccccaggagattatcttcctggatttcaaccacttctatgccatggatgagacccatcacaaatgcctggttctgcggatccaggaggcctttggaaacaagctgtgcccagcctgcagtgtggaaagtttgacgctgcgaactctgtgggagaagaactgccaggttcttattttctaccactgtcccttctacaagcagtaccccttcctgtggccaggaaagaagattccagcgccctgggcaaacaccacaagtgtgcgcaaactaatcctcttcttggagaccactctgagtgagcgggcctcacggggctccttccatgtctcccaagcgatcctcacccccagagtgaagaccattgcccggggcttggttgggggcctcaagaacacgctggttcataggctggcactgatcccagtttatcctttgagattcagcagaagatcctgatggaggaggaggataccaagagagaggtgcccaaggaagatggagttggtgatgtgcaacatttcggtgagaactttattgtcagaggttttcagtacatatttacaagttcttactccatcatacatattgggaatgagctggcattttcaagcatatacccaggagtccagcaatcattggggaagagagcctgaggctggcaatccttgcccagaactttggtcacctgcttgttcacaggccaccatatcttacttcactgaagacatatgctgaggttttatttagtccagatgctgaaggatgggaagacccaagcagctggtgtggaggtctttcccagtgactcatcagtcattcaaaatcaaagcctgcacaagaaagggtggggtgggatgtatagagaaagacaccaagcctttagactccagcagagtagctgatattgacatatctgaggagggaggaggctccaatacgactactcccaattcacagggtttgtggttctggatgaaatctttgcaaagggtttccctggcactcaaacagaataaataggcttataaagtgt

SEQ ID NO: 756 - DNA, 2453 bp, Homo sapiens
ggactgggagccggagccggggcgggaaccggagctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctagctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgtccctcgtcgttaaaaaacagcaccctatcctgcttccccacatttctgttcctccaatgaagggctaagactatttagtaatctctttcttaagcagaggagtggcaaggatggcaatcttgaattttattttctgtagagatagcatttcttctggtgcggagctgaaaggaatccacccagaagttctgtagcatcctgcgtgcagcctcctggagccccagactccatctgggggagggacttgtttacaagcagttctgaccaccttagtggtgtactgttttctaggcaaaaaatatctgtctgttgtactgtatagcctttaaaatgcagtccaggaatgagactcttttaagaaacacatcctgcttctgcaattccagagagtgctgggggaaaaaaagggataaaaattcctacctactcatcagtgtttgaaagatggagctgaatagcttttcttgttcctggactaggcaatgaataagcaacaatgtatcttttctgtgttcaaaataaatacataatatcaataaaatgtagcaagaagtaac

SEQ ID NO: 757 - DNA, 2116 bp, Homo sapiens
aaaaaaaaaccttcaggcggcccatgggtgagtggtcgccaagatcccgggaagcgtttctggtagtcccgactactttcctacacggctggcctcgggctcggctctttgtaggcggccttcggttggcggcgcaggctcgccccttgaccccgcccgccctcgggccgggctccgcactcctgcggggttggggtggtctgtccgcaacgggctactaggggaggcgcgctgtctgcggcgaaatgccaggtctttgttgtttggtccgaaatgtctcttcagtcccttagtttaatgtcgagggaacacttgcttgagggttgacttcggaattgaaaacgcgggtgatagtgcagaaaaaacagtaaagcagaagcaagttgctgcataatttgtctactgcttcaacctcaaacgtagatttatagcgcccgtcacaaagggcaggaccgctgcaaaaaaatggaatcttaaaactttagccatcgttcgctaaaggaaatgaaaggagaaattcaacagtcgcttggagcctgggttttgcttactgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgggcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcgtctctcaacagttcagctgttctttagggcaaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacat

SEQ ID NO: 758 - DNA, 1913 bp, Homo sapiens
atgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcaccccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggcaccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagt

SEQ ID NO: 759 - DNA, 2389 bp, Homo sapiens
agcttctcctggccccctccctgtgtctgttcctgtccccgagcctctggcctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactcatggagcccttgggactggtcgtgcatgggaaagctgaacctttttccgcagcactccgaagccttgtcaacaacccgcgatacaggtggccgtaacctttggcctggggcagctgcaggagcgctgcgtggctttcatagaggcccacagccaggtactgctcccttcatactcctcaccctacgcaccgcattctgctcctccctgacccatttgccggctcgcaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctcactctacgccctgcccctgggcattgtcgtctactagtctattctgatgactcccacatatctatctgttcagctcagctccctctttcttttctttttctttctctttctttctttctgtctttctttctttctttctttctttctttctttctttctttctttctttttctttctttctttctttctttttctttctttctctttccttccttccttccttccttctttctttctctttctctatctctttctttctttctttctttctctcctctctcttttttttgagacggagtctcgcactctcgcccaggccggagggcagtggtgccatctcggctcactgcaagctccgcctcccgggttcacgccgttctcctgcctcagcctccggagtagctggtactacaggcgcccatcaccacgcccggctaatttttttgaatttttagtagagacggagtttcaccgtattagccaggatggtctcgatctcctgaccttgtgatccgcccgcctcggccttttttttttttttttttgagacagagtcttgctctgtcgtcgaggctggagtgtagtggtgcgatttcggctcacttcaaactccgcctcccgggttcaagcgattctcgtgcctcagcctcctgagtagctgggattacagacatgcaccacaacgcccggctaattgttgtatttttagtagagacgggggtttcaccatgttggccaggttggtctcgaactcctgacttcatgtgatccgccagcctcggcctcccaaagtgctgggattacaggtgtgcgccaccatgcccggcctcagctccttctttcattccagacctgcccccctggagatcgctccctgaatgcccctcagacaccacaggctcggcgagaaattgatctccccagcttttccccagctctgcccccatcgtgtttctcatttccgtggacacccacgccagaaacctggatctcatccttgccttatcgctcttcacacctgccttaggtctctttttaccttgtaagagaccttaagagacctttccagttggttcagttctctcagccccaggttcaacctgtcctgtctgacacgtctcacagccttcctgccttcactccagcgccccctcaatccatttcccacagtgcagccagacctgtttttgattgtcagtcctatggggcttaagtcctggaacatcccattgacctccaggacaaaattcaatctatttcactttcagggc

SEQ ID NO: 760 - DNA, 2052 bp, Homo sapiens
aagaaaaataaggacttgaggttattgagaagacttaagagtcagtggcatccctcagcacaattttaagaagtctaaaatgtgaaaaaaagtttgtacattgaaaacacggttctgatctttttttaaaaaaacgttctcttggaagggaatatgagtttttaaaatcaggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcatacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgcggtccacctcaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggcc

SEQ ID NO: 761 - DNA, 2656 bp, Homo sapiens
ccgtcccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggctgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaaccggttgttccagattccacgcagaacttggaagacagagaagttttgaatggtgtacagacagaactactaacttcgccaaaaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaggatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggattttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgc

SEQ ID NO: 762 - DNA, 2759 bp, Homo sapiens
cttacccacccgtgccccagagagaagtggctcgctgctcacaccccctcctgccagtgcagcgcgagtaagagcgcccaagggaccacagctggcatcccaggggttaatttcggagcagcccaggtggaggtcgagcccccaaccccgtcggcacctccaggcttccgaggccaccggaacggaggaggcttcggtggctctttgtctacctgctctgggtgttaaagagcccgctcgcagcctgcatcgccggggctcgggacagaagtcagcggcggggaaatggggctctgtcactttaagtacagctggagccctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaagatggagtttcgttcttgtcacccaggctggagtgcactggcgcgatcttggctaactgcaaactctgcctcccaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcg

SEQ ID NO: 763 - DNA, 2233 bp, Homo sapiens
aattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagccggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctatggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatcccagctactttattgacaaaaaggcagtgaacataacctcacttaattctggtgtagggtgtatgtgctaatcgttctaattcttgattacctagtttatagataactgctggtcttaatcgcagagtacagagaactgaaccagctcctgatattgtagttagcagtcttcctggcttctcactctgccttatatttccatgtgggtttacttctctcataactactttcaaggtatttttcttccaagctgaaataaaactggggccacat

SEQ ID NO: 764 - DNA, 2080 bp, Homo sapiens
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccaacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaagtcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatac

SEQ ID NO: 765 - DNA, 2390 bp, Homo sapiens
cataacagagttgcaggatcagctaacgtcaatgcctgggcaaagctgctgcccagagtggaatctcactagtgaataaacaagcccaagaaagattatcatctcatttgcaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaagaaagccatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccgatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatacgacttttctgagttatttatgtacttaaaatatgttgtcacagtatttgttcccaaatatattaaaggtaaccaaaatgttaaaatctg

SEQ ID NO: 766 - DNA, 2570 bp, Homo sapiens
ggactcgagcgctccgattggagttagggcctgcttgtctgcgtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacttctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatat

SEQ ID NO: 767 - DNA, 2190 bp, Homo sapiens
atggtgacgcacgccgctggcgcgaggaccttttgtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccgccgcccccttctccagtgctctcgaggagggtgcaccagggctgccccaccctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttggaagtggctggctctgcagagtgatggacagcaggtggcatcttacattgtgatttgtggtgcacagttaaaacacttcccttcgtttcagaaggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctgggtagtatatacacacatacgcagagccttaggaattgtgaaaggccaatcaaaacttggggccctaatttcactctgcc

SEQ ID NO: 768 - DNA, 2222 bp, Homo sapiens
gcatagaagtaagaaatcaggagcaaaggttgggggtggggaggaagcaaaattgtcctcgcagcagagaatgcctaagccaggaggaacttgtaaatgaaaaccgctcgcattagcaaatgattatttcctccaacgctgaccgtctcttagacccacagaaactcgaggaccggtctgcaccctggctgacttgggcctgccagagctgccgggctgagccctctcctccagaggactgcactggcctgaactgtgcttataaagaatctctgcaaatcaacaggaacttctcatccagagccgggatagggagggctggaatggaaatgaggctgtggaatgaaaggtcactctcaacttggggaaaatggcatttcaccaggaacatcaagtacctcggaggcagaacatgcgaggggcagggaacgccaagaggaggcacttacctgccattgagaaagtgcggctgctcagagggcctagcctctcttgttcaaaagagaacagaggctcacccacagcagacattcctgcttccggatcctcagcggcctctcccagggggaggaggaagaagcaaagagaacaggctaagagtcaccacttaccaggccagccccggtcttgtacgcattaggtcgcccggcggggcaaggacactgtcacctctttgcaatcaggcagtctgaaacccagcgacttgccttcatgtccccgggctttcgcctataatttatcaccctcaacagcagctcggctgagctgaaagtctccggtgcagtgcaccgaagagccattgatttcgtgggattgtgaataaatacgaggaactgcagttgttctgctggccgaggtgacaatatcagaagggagcctggggggagggaaacagctgtggtttgcattttgaagttgtttttaacatttttagtaattgtttcagattctccagttctgatgcccctctcctagaaatgagaaaacccatcttttatacttgaggtataatcctttcccactagacacagcctcctccacccttctctcaataatgcagaagtggtgattaaagggcacattcatatgtaaaaggcgaacttccaaactcgcctggcaggacagaaattgcttcaatctacagaaaagaggctgatttacaattgaattcagtgtttagccctcaacaactagaggcaatagcaaccgcggccctttctcctccccagctgggatgaggccctctggaaaaacgacaacatcgcaacaggaatttcctggatcaagaatgccaagttctttccaattttactgaggcaggatccgactccctgtgagaacgcactgcccaccacccacccaccccctcagcaggcccaggccccaaaggctccctccaacatgtgtacatgaggcccttcaaactcgaccggaacaccacaaagaatgtggagaaaccggttgcctctggcctttacattgtggctggctgaggagctggttctggtggctgacacccgttggcactatttatccagcccctgcctggcttgggttctggaaatctccggtggtagtggcttccaaactgcaatggggaatcgcggcgtcagagggcaattcagaaacaaaaagacagttctgtgctggcagcatttgaagcacagaagtgggttgggagaagcaaagggaaattagcttcagaaagggggcagatgaaggaagaggcgccactgctaaccaaccaaggtccccatctgccctggatggtatctctaaaagccacctaaagaaggcaaaattctctactgaaacgccaggtacgaagggacaggccctccacagtcaccttgtcacattcctttggggagcgaagagttcagacccaacatgtcacccaaattaccctggccagccaccacgtaaagatgctgcggctgtgcatggtggctcacgcctgtagtcccaacacgttgggaggccaaggcgggcggatcacctgaggtcaggagttcgagaccagcctggccaacatggcgaaatcctgtctctattaaaaatacaaaaattagccgggtgtggtggcacacacctgtggtaccagctactcctactggggaagctgaggcaggagaatcgcttgaccccaggaggctggagtgcagtgagtcgagatcacgccattgcactccagccggggtgacagagcaagatgccatctc

SEQ ID NO: 769 - DNA, 2498 bp, Homo sapiens
attcacggcacccctgatagcgaggtcggcgtcacggtgtaggcgcgcagttggggaaaccgaggcccaacgtgggcggcagctaccagagatggcacacggaggactcaaattcgtccattcagtcattcgttcattcattccttcgggaaaccttgcagatctcccaatctgggcaactctgagctgggcgccagtagtctgggggtgctgacgggaggaggggccagagttttcaaagacgattaaccgaggctcacgtcgcggagccaacctagaagttctctggggacagaaccttggcggacaactgaattaattgttctagtctccaggcccagtacatggatgcttgttggatgaattaatgaaccttgacccacaccaagattctgagaatttggtttctgtcaagatgtgcctctccagccaggcctctcctgccaggacggtggccacagggccatctccctctcctggcgcccccaactgcctggccaaggtgactgctacacacgtggggtcgcagaatccctcgagtcacaacgtcttcaacgtcttgtcagtcccgtgatcgcactaaacgtatttaaagccccctactccttcaagagggtcacctctgtgtacaggcggcctcctcgtactaagtgtggtggcgttcaaggctccgagacacaggcgcctcccgcgccactccccgggcacaggaactcctactcatccctcagtcatcagctcgaaggtttcttctccaagaagcctgcccggcactcgagaagtagagccgcgagccttctcccgggggcccagccttccccagtaccggcagggatcaccccgggagcacgcgcccggccccgctgaggccaggggctcctcggaggcgcgggaaagccggggaaccagcgcagttacggcacacacgaggcggggcctgcacagatgccgggcgcccgatcctcagtgacaaaatagagactccgtggaagggacactgaggtgggggaggctgcggtgatcccataccgcactccaggtgccaggctccgccccgcccctgacggcgcttccggatccggcgggtgccggaagtgggcgggcggcggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgctttgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacattt

SEQ ID NO: 770 - DNA, 2478 bp, Homo sapiens
actccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacataactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgttt

SEQ ID NO: 771 - DNA, 1766 bp, Homo sapiens
aaaagtggcgagagccacctcggcgcttgggcgctcagtcgcaggaggcgctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagatttggctacacaatttcaaaacctgcatttgtgttcgtgaggcatctcataacactgtgtgcattgtcatgggctaaaaaggaaggcagagaaacactttggacaatcgaggagggaggagccaagatggccgaataggaacagctccggtctacagctcccagcgtgagcgacgcagaagacgggtgatttctgcatttccatctgaggtaccgggttcatctcactacggagtgcgagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacaagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagatggagatctgagaacgggcagactgcctcctcaagtgggtccctgacccctgacccccaagcagcctaactgggaggcaccccccaacaggggcacactgacacctcacacggcagggtattccaacagacctacagctgagggtcctgtctgttagaaggaaaactaacaaccagaaaggacatctacaccgaaaacccatctgtacatcaccatcatcaaagaccaaaagtagataaaaccacaaagatgggg

SEQ ID NO: 772 - DNA, 1952 bp, Homo sapiens
cttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagcccctcccgccgcgcccgccccgccgccccccaagccaggcaaggagctgaggaagcgctcggtggaccaggaggcctgcagcctctagactgatgcccctgcccccgcccatccgcccccacgctgtacagagtgcatgaggagccgccggaccaccggggaccgactgcctgcgtccagccgcgccccatccccgaggccgcctgtggccaccatgtcggccctctttccaccaccccttgctcagcatgtaagccccacccacccctgccctttcagacccctgcggtgacctggctcggagaaggtggccctgggcaccaaggggccaaccgccctgaacactggggcagggaccatgctggggcccggggccacccccttcctgtcaccagcttctgtggagtccagtgttttgctttgcttgcttgtcccccatcctgtcctgagccggggccccccagcctcgcctccctcctcctaccatccctcacttggacctgggggtgtggacagtgacccctccctgaatatggacttgaatcttctgagcagaactagggcctctcccctggtgaagacccagggaacccaggagggcccttctggggcagtggctctgcagggtcactcatggaggcctaggggaacagcgagatgccccaccacctcctggcgagtccttcctgttcagctccctgtgcgaccctccagggatgcaggggatccaggattctctgccctgtcacacggcgagtcagaagggaggggcctttccctcggacccatggccccaggcagagttttgcaccagcaggacccctttgagggccttcaaggctctcccaggagtccccctctgccggccccccaatgccccagctccctcttgggtcctgtgccaagtccgccccagggcctggggctgttgggagccaagggccccctggtactcagttccctcacgattcccgatcacgggcacacctgccccctggttatttgtaaatatttctattggacccaattctcctcggaattggctggcacctctggttgccacagctcagtgatgacgtgggggaggtgggagaggccgagggctttgcctaggggtgggttgccctgtatacatgatccagtctgtgactaccagccaacctgaataaagcggtttt

SEQ ID NO: 773 - DNA, 2729 bp, Homo sapiens
tacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctacgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggagttctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctgtgaattcctttatattgagcctttcagaattctccctgggtgggcaatttctttaaatagtatttgaccctcagatcaatcctgggaattttttccatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatggtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtg

SEQ ID NO: 774 - DNA, 2031 bp, Homo sapiens
gcagcaggcggggcacccggactggcggcttcgctggcgcaaggtcggtccggcggccagggacctggaaggctgcgaggccctgcgaggtcgaggttcggagtttgctggtcccaggcccagcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcagtatccttttgtccagtgtcctgcaccctggagggagggcagttgtggggaggctgggagatagggtcatgtctatccccgtgtggggaagctgggggatagggtcgaaggcctgggtgggctgcagctgcgatcctggcccgccttgacatgctccccacatggcgtcaccttcctggcatttgggaatggtgcacctgacatcttcagtgccctggtggccttctctgacccgcacacagccggcctggcccttggggcactgtttggtgagagcagccccagtgaggggggcggggaaagcagcaggagagggtgcagggtggctgagctctggcctcctccccccaggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggtgagcagctctggggctcaggcgtgagatcccagggctgatgggcaggaggtttaggaggtgcctgggacagagaggtgtgaggggtggtcagtgggggctttgatttgattacaagtgacagaaaccctcctcaagctggcttgagcaaaaatgggaacatgtgggtcacataaccaaagaggcctggcagagctgggggctggggagggagtattcaaaagtgtcacaattttttggccaagcgtgatggctcacacctatcatcccagcaatttgagaggctgaggcaggaggatcactttggttcaggagtttgagaccagcctgggcaacatagcgagactacatctctac

SEQ ID NO: 775 - DNA, 1774 bp, Homo sapiens
gagaagtgaagtgcctggggtcgaaggagctgcttgccagtgtgcagcaccaaaactctagccattctcagatgttaaggattttttttttttttttttttcctgagacagagtctcgctctgtcgccaggttggagtgcagtggcgtgatctcggctcactgcaacctccacctcccaggttcaagcaattcttctgcctcagcctcctgagtagctgggactacaggcacatgccaccacgcccggctaatttttatgtttttagtagagatggtgtttcaccatgttggccaggatggtctcaatctcttgaccttgtgatccacctgcctcagcctcccaaagtgctgggattacaggcatgagccactgcatccggcctgttaaggatttttaatggatgtctagaaatgaaagctcaggatctctgaattgggctattcataccctcccgtgtacattaaaaaatactattggaaaagtggcaagatggctgaataggaacagctccagtctgcagctcccagcgagatcaatgaagaaggcaggtgatttctgcatttccaactgaggtacccggttcatctgattgggactggttagacagtgggtgcagcccacggaaggcaagcagaagcagggtggggtgtcacctcacctgggaagtccaagaggtcagggaactccttaccctagccaggggaaactgtgatggattgtgctatccagcccagatactatgcttttcccatggtctttgcaacctgcagaccaggagattcccttgggtgcctacaccaccagggccctgggtttcaggcacaaaattgggccgccatttgggcagacactgagctagctgcaggagtttttttcataccccagtggtgcctggaatgccagcgagatagaaccatttactctcctggaaaaggggctgaagccagcgagccagtggtcttgttcagcggatcctacccccatggagcccagcaagctatgatccactggcttgaaattctctctgcaagcacagcagtctgaagttgacctgggatgctcaagcttggtacggggaggggtgtcggccattacggaggcttgaataagcggttttcccctcagtgttaaagccaccaggaagttcacacggggcagagcccaccacagcacagcaaagccgctatagccagactacctctctagatttctcctctttgggaaaggcatctctaaaagaaaggcagcagccccagtcaggggcctatagataaaactcccatctccctgggacagagcacctggggaaaggggcggccgtgggcgcagcttcagcagacttaaacgttcttgccagctggctctgaaaagagcagtggatctcccaacatagcacttgagctctgctgagggacagactgcctgctcaagtgggtccctgacccctgtgcctcctgactgggagacacctcccagcaggggtcaacagacacctcatacaggacaactccggctggcatctggtgggtgcccctctgggacgaagcttccagaggaagaagcaggcagcaacctttgctttctgcagcctccgctggtgataccgaggaaaacagggtctgtagtggacctccagcaaactccagcacacctgcagaagaagggcatgactgttagaaggaaaactagcaaacagaaagcaataacatcaacatcaacaaaagggaggaccacgcaaaaaccccatccaaaggtcaacaacatcaaaaccc

SEQ ID NO: 776 - DNA, 1854 bp, Homo sapiens
aagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagcttattccactaagctcaacaaatttcctgtatttaatattaatgatgacttgaatgatctgtgtaccagtgcagtaagcccaaatactaccaaagccacgcggtacgccttgaatgtgtggcgttattggtgcatgaccaacgggctcaaagaccacacagacatcaccaagatccctgcagtgaagttgaacgagctgctcgagaacttttatgtcaccgtcaagaagagcgacggctcggacttcctggccacctcgctccatgctattcgccgaggcctggaccgcatcctgaagaatgcaggtgtcggcttttccatcaccagcagcaccttcagctcctccaccaagaaactcaaggagaagctgtgggtgctgagtaaggcaggcatgtcgggcgcgcgttctcgcaacatcgtctacttctccctttctgacgaggaggaggtgtggcaggcagggtgtctgggggatgacagccctatcactctcctgtccactgtggtcaagtacaacagccagtacctgaacatgcggacgctgcaggagcatgcggatctgatgtatggtgacatcgagctgctcaaagacccccaaaaccagccctactttgcccggacggacagcgtcaagcgggagagtcggagcggctccaccagagtgtgtcacgggaagatctaccatgagcattcccggggacacaaacagtgcccttactgcctcctctacaagtacatgtacatccaccggccgcccacccaaatggaggccaagtcccccttctacctgactgccaggaaggaggccacagacatgggcagcgtgtggtatgaggagcagaggatggggctgcgctctcttcggggaattgtcccaaacttagccaagaaggtcaagctggaaaactgtgagaacttcacctttgtctcgttcactcaggtctcccggaggcttggctcccacagctgctgccagtgagcccccactggggcccggccactgccctgtcacctgctcgggccagccagggttggagcagctggagctccttggaggcaggggctgaccaggtgtgacctcccggtctggcggctctcccctggtgtggcctgccctccctttgacttggggtttgctttttaaaatgaaactagatgagtctaaatcattcggatggtttatccaaatgtgcgtcaacttcgttagcttttagaatctaacacaatgtataattgttacatacaagagtgaggaaattcattttctctagtgcctttctagcacaggttttctc

SEQ ID NO: 777 - DNA, 2836 bp, Homo sapiens
agtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaagtgggttgagatagctgttcccctccttcaggcaggggcaaaaattgacctctgcctctctcgagggtcaaaaagttcctcagggcagggtgggttgttctttgggattagagctggtgaattcattaaatatcggcttagggaggggctgaatacagtaaaagaacagccttgagccttggagggtaaagccacgtttttaaggaacaattcagagctggccaggtcatgcttaacttggatgatctctaatcgcgcgaactgctcttatacccatttgacaagtggggaaactgaggcttcaagtggcaggaggtctcccactttgttatcggcagggcagggaggggaaaccaagacgctacagggtctccagctttttaccatctgctcctctctcaagagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcaaagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttggggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactcctt

SEQ ID NO: 778 - DNA, 2800 bp, Homo sapiens
aagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagaggtaaagggcgctccgcagccaggagcgacccgcgcactccccagagccggggccacgagtggctggcggcgacaccagagtggaggcgcggcactgctttaccaagaccataagtgaacgcagtctggctttcggcctccccgctcctccaaaacttacctgccgaagtgccaggttgaatgagccgtggatgccttcccgcccgtgtctcctgcccagcgtttcacacgactctgcttagcctagaaactgccccaggaccttgtcctccaccagcttctgaccactctttccttctgctggttttccttacttactggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataaggctgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatg

SEQ ID NO: 779 - DNA, 2934 bp, Homo sapiens
ctcagactgagggagaatcaattttgggggagaccacatctaatggataaaagagccacaggattacaaaagggtggaatagttgttacaagaaggtcacatcatcctggcactgctcccagaaccagtgggcctcgaagcccagcttggcactctcatcctctggtgactcaggtggtccaccttgaagcctctcccctgggggcttccacacagctctcaagctccctagcctggtggctgccacatccacctcagtcctggccctctctccaccagctataacttttgcccagtccatctcggaacgtggagccccaggtgggccctgttcatccagctcgctgggggccactgtgtccaggaagctgccaatagagacactgtccagccggtcggtggtgctggtgtctggcaggctgtcccagctgcctcgccttgagcggcctgggctcccgcctgtcaggctatattgactgctggtgaggctgctgcaatgactggtcaacgtcccccgctcctccaacagccagcgcactgcctcgatgccctcattcaaggtcaccagctgctgcaggatcttcacatcgatggctcgcagattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaaatcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtgagtgaagaagccaccctcagtcaccccaattttcctaaagccacccccaaaggaggagggagccccaggagccccagaacagacatgagacctcctccaggaccctgcggggctgggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggg

SEQ ID NO: 780 - DNA, 2458 bp, Homo sapiens
cccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagaaaaaaaag

SEQ ID NO: 781 - DNA, 1914 bp, Homo sapiens
ttggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagcttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagctccagctacagatt

SEQ ID NO: 782 - DNA, 1718 bp, Homo sapiens
agttcgcaaagtccgggcttgcggccgggcggcgcagaggcgcggaggctccccgggcggctgcatcccggggctgccccggacatgccccgcaccccttgtcggacgcccgcgccgcttcaccggctgccactccccggagtgctctgggactagagcgccctccgccccaacttctgactttggggtcccccagccctagaggaacgggcgcccggctgggggagccccgggcatggtgtgacggggcagtcaggtcagctttgcggcgcccccaaactccagccacccgtcgtctccgtgccctccagaatgtagctgctgaccccgcgccccccggactccagcagcagtctccgccacctccgggctccagcagccaactcttgtgtctctcaggaacccgccgacgtctccgcgtcccccggattccaggttcgcgacccccgccgtcttcgcgcctccgggactctagcagcggtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggctctgaagggctccaagaagctggtgctgtctgtgtactcagcagggcgcatctctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgagtggggtggggaaaggaggccagcctctcagacaccgtattctccctccgaacccagaacagcagagctgcttggaggccgcaagaagaggctggttctgtccaggctctgtcttccctcaagtctgtactgaagggtggtgttttttctttgcttttctttttgacctgtgtagtgtatgttataatacaggctaagctgccacaataaaagagcttaaatactgtg

SEQ ID NO: 783 - DNA, 2142 bp, Homo sapiens
aattttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcgggggagtttgggtcaaggactgtccctccagcagtcgcctcctcccaccctgagccccacagtcatctggccctttccctgctcaaccctccctcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctc

SEQ ID NO: 784 - DNA, 2035 bp, Homo sapiens
gtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacggtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaagaaaagtatgtgtaatatgaagtaaaatgtttcagacttttttttat

SEQ ID NO: 785 - DNA, 2840 bp, Homo sapiens
attgccactcagaatccccgcgcgctgctcggagccggagggagcgctgggagcgagcaagcgagcgtttggagcccgggccagcagagggggcgcccggtcgctgcctgtaccgctcccgctggtcatctccgccgcgctcgggggccccgggaggagagagaccgagtcggagagtccgggagccaagccgggcgaaacccaactgcggaggacgcccgccccactcagcctcctcctgcgtccgagccggggagcatcgccgagcgccccacgggccggagagctgggagcacaggtcccggcagccccagggatggtctaggagccggcgtaaggctcgctgctctgctccctgccggggctagccgcctcctgccgatcgcccggggctgcgagctgcggcggcccggggctgctcgccgggcggcgcaggccggagaagttagttgtgcgcgcccttagtgcgcggaaccagccagcgagcgagggagcagcgaggcgccgggaccatgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtgagctggcttccagtgggacacaggctaaaaagaggcagctcatgcatcatcccaccacatgggagaacagaatggaatggaatggaatgaaatggaatggaatggaatggaatggaatggaatggaatggaatcgaatcgaatcgaatcgaatcgaatcgaatagaatagaacagaacagaacagaatagaatagaacagaacaatctactacccatattctgacatattttcttccccttaaatatttgtgtgtgtatatcagtgcactcatatattcaaatatccatatgtgttatctgcaaagctaatagtccatattgcgattgtaccataatatagttaatctgtaatctgggacatattgttcgcttacagaattttacactattttaaacacggtttggataaacatcattatttatc

SEQ ID NO: 786 - DNA, 3045 bp, Homo sapiens
ttgtttgttgtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggtctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgactttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 787 - DNA, 2661 bp, Homo sapiens
gtagcggtgctgggtcgggccgacgtgccacccacccggagccggtgagtgcagccgcccgccctccggtagatctgcggcctggcggagaagtcgggaggggacaggaagggagggcgggccccgggccctcctccgtctcagccgcctgcggaggtgctgcccacgcctggaggcccccactgaccctcagacccgcgtctgcgcccctctccccgcaccccgaggcagagttgggaaagcagtggtcttagaccccccacctcgggcactcggaagagaacggcggagacaacccctcctcttccctggctggcgcagcgccagcctcgagctcctcggtagcccccgggcagggagggcccgagggtgggcgcggcatcttcagcgactcttcgaagtcccttccgcgtctcatctttcaaggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccggtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccagaaaggaggatgtgggcagggacggggtacagaggatagtgtgggtcagaggtgccagtagtataatattcatctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggtttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcgggggtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgc

SEQ ID NO: 788 - DNA, 1947 bp, Homo sapiens
aagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcgggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagacggacccaagctgtaccgtgggcttctatgctggagacaggaaggagtttgggacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttg

SEQ ID NO: 789 - DNA, 2409 bp, Homo sapiens
tgaattccattgctttgaaatgtttcctattactgatttttttttttaactttccttgacatcttgaatgtgttttttttgattgatgttcaatatacccagtacccatggtaggtgtgggtcatgggcctctgctgtgtctcttagtgttcttttccacgggcccctaaaaaagtacaggagtggccaggcacagtggctcacgtctgtaatcccagcactttgggaggccaaggcgattggatcacttgaggttaggagtttgagaccagcctggccaacatggcgaaaccccatctccactaaaaatacaaaaattagccaggagtggtggtgtgcacctgtagtcccagctactttggaggctgaggtaggagaattgcttgaacctggaggcggaggttgcaatgagccgagatggcaccgctcccctccatcctgagtgacagagcaagactctgtctcaaaaaaataataatttagctggtcatggtggttcgtgcctgtagttccagctacttgggtagggactgaggcgaaaggatcacttgaggccaggaggcagaggttgcagtgagctgagatcacgccactgcactccagcattagtgacagagtgagaccctgtctcaaaaaaaaaagaaaaaaaaagggaagaaaggaaactgaatctcagggaagtgcccacctcctgagctaataagaggaaggaatatgggggtgaggcagagctggcaaaaggctgttttttgttttgattgtttttaaagaccaagtgaagtatagtataagaagtggggaaggagtggaacaaggagttagatctgtaactgtgagtagtcaattgagataactcaatacctttggacctgattgtttttaaagactgagggtagtataagaagaggggaaggagtagaacaaggagttagatctgaaactgtgagtagtcgattgagataactcactacctttggaccagccagggctgtttataagtgctaaagcccgaacaaaccaaagagttggggagaaaggcctaactaacagctgagtgattgtctaacagactgtcttttaggccagtgactctggcatagggcaggctgcatagccagcaacatcccttaccacaggtctagtgattcctctgggctcaaatgtggaggctacacacccactccttagcagaggttggcctggcacctgctggtgccccaagaactatggcatggttagaccctggccacttgattgcatgtgcctccccagtgggcgtgccctggttcccaaccagttgtggccactgccactgccctgcctggggcaggagttgaggttaaggctaactacaggctccttccaggccacctaccactcagaccctgcaggaggtagcacaaagcattcacagcctgtggagtcagaggccaatttcttctccctgagcaagaagaatggaagcaaatgaaaagtgctcacagtatgctcaactgcccctgctcaggtgaagaatagcctgtctggatggagagatgtcaggctacttgatactcagaaaaacaggtctcaaaacagtgccttccaaataatacatgtggatgtggacactcttctatagacgaggtggagcttaattcctgtccttacccccatattcccacctcattaccaccctttgaaggtgaactagacttaatgatacttcccacgactaaagtagggaaagggaaaagtcacaaacttatagtggggaagcctggcagacacctaaccaagtgatgtcatgtatatgtcatgagaggggtgcatcacttccctggtattcctaccaaaaacccaaattcccagtgtatgatcttgagacaaatgttagacaaatccagacgtggggtacattctacaagatacctggccagaactcaagactgttgagatggccgggtgcagtggctcatgcctataatccccgacactttgggaggctgaggcgggcagatcacttgaggtcagaagttcgagaccagcctggcaaacatggtgaaaccccatctctgctaaaaatacaaaaattagccaggcatcatggcatgtgcctttagtcatagctacacaggaggctgaggcaggagaattgcttgaacccaggaggtggaggttgcagtgagccaagatcgcatcactgcactccagcctgggcaacaagcaagactccacctcaaaaagaaaaaaaaagactgttgaggtcatgaaaaataaggaaagactcaaaaactatcaacagaccactaaagaccaagaagacacaatggctaaatgcaacatggaatcctggagtgcatcctggaagagaaagagaacattattggaaaaactgataaaacttgaataaaaactagtgtttaatgt

SEQ ID NO: 790 - DNA, 2397 bp, Homo sapiens
gattgacaaattctgtaaaggttaagacagtaactattttaggctttgtgggctacatgtggtctctgtagcacattcttctttgttgttgctgtttgttcattcgtttgttttgcaacctttggataatgtaaaccactctcttttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgctggaaagtctggcagcccaggccataggattccagttcagcctacgatttcctagggaaatcaccaagttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcatataaacgttgcgggataagaatggatgatatgtatgtgtctgtgtgagtttggtttctcaacctggactgtgagggctaattcacaaatcacaccatacatgcgcgtgtgcatgcgcacacgcacacacacacacacacacacacagtccagcaccctcatcagttctctggtttaggttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgaagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaggcattccttactggcttgctaccagcaattgaactgtattctttatatagctagagctgtttgtgtcttcttaaaataaactttttctgttaaaatc

SEQ ID NO: 791 - DNA, 2907 bp, Homo sapiens
attgtggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacgacatattcgcttagaaaataatgaaaagcgtcaagaagaggaggaagccatgcgtagggagagaaatagaaacaaacaataaccgtatgaagatgtcctgttaaatttacaacactaacgatgtagactttggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtg

SEQ ID NO: 792 - DNA, 2174 bp, Homo sapiens
gcttcgacttccgggtgagaccgtgaaggtgtggcgcgacgttggagaccggggcagcgccatgtaccacagtggatggaaggatgcgcggtgcggcggggcagctgtcctcttctccccggacccagcgcctggagagccagccctgcagggtgggctgggcgagccaaactgcgttcctggtgcagggcttcgggtctccctaacagaccttatacgctgaccggcggccgccatggcagtgtctctttgctcagacatccagggacgaccacattcgtccaacagcggtcgctccaccaatcctgggagaagcgaatcgttttctccgcgtgccctgtcagccgctcatggtgcccagagaggaattttagtggcagcattccggctgtcacgccaccgaaattgccaggccactccaagtcagaaggaccaccaggaaaagtcaggaagagaaccaccatcaggtcccagcctctttttgtgacaaggactagagggtttgggtctgcagtgggctggctcccgctgggctcacctgtcctatagagcaggctgcctcaaggaagaagctcacaggggacatctgacatctgaaacagcaagtgtaaaatgctttaaataagccaaaactaaaccaatcgttatgttaactaaaaatacatgaatgctaccgaagatagtcgaatattagaggaagagattaaactctgattttgagcactttgtgctttattcggaaaatgaataagatgcagttctgaaaacctgaaaatataaagaataggatatgatacgcacactagatgaaaacaaaactttcagaccatattttcttatttaaagctctaataagtgagatagcagagtaaactattcactcaaataattagtaactgatataagggtatgtatcaataacaggtattaagacaaaaactttatgagcttttccattttaacaagggatgatgattctagacttctgccacaacattatggtcgacaaaacattcttaattcattttacatagatctgactctagattctgaaacagcaagtcataatcttgtatctctaaagatagaatacagtgcgatttggaaagacaccacaaaaactcatgatccaaaaaagattaaggctgttattaccaggaggaagagaaagaggacaaaatcaaactggatagatataatagagttgtttgttagaattgtcttcccaggagatggaaaaagacgccatcacaataggattcatgctttagttttcagctatagaaatgtaataactttgccaaagtaattacactacatagagtggcaatcgttctattaaaagtaagacccagtaatgttaggatttgttctggacaatgaaggggatgaggtttaatcttatgacttgaatgccaggtctgaaatcttttcttcaagtgatatttttatgaaactacttaggctgtgtttcacactgggtatgatttctaacctcttataacctgtacagtaatagattatgaaggatgaattatttgaaagctattttgtattatttaggagaggagctcttcaattctgaattgtctgccacttacaagcagaagaaagtttttttctttcattattttagcaactatcaataaaacagtattagaaatgcctactcttcagagatgtaatgggaataaattgtaaagtacttttgatattctaagatgaaagatggtattacacagtcaataattcaatgcttcccacattatgaattttatcaaaattatgtagagagctattagttcattccagcaacaaaacaggcttatataaaaacaaaaacctcctgggtcatgccatcctacaccaaattcctgttaaacagaggcatgatttattccagtgaccttgctatttcttcataactgtaatatgtctaatgttagacattttaaattaacattctattagataaactgagaatttaggtctctcgcaccacccaggcacatactctatctttccccacaaatatccaaatatggtaatataattggattaatacgttcatatgactatataattgttcacagctgagccacttaggtgctataattataatttctttgatacacaaattttgttttattgtgattaaaattgcctgatttctt

SEQ ID NO: 793 - DNA, 1876 bp, Homo sapiens
accccggtgcggtcccggcgcctgcgcgctgcggactgtggggcttctcggcccgaggcagaggaacagggaagatggcggctgtggtggagaatgtagtgaagctatcgccctgggaggtctgcagagcccactctggatgaggaggctgaggctctggacaccgagcccggtgctcatctccagcttgagcgcccccaaacgcccaccccccagcggcgcggccctcacatcctgctgctgcttctcctcgtccaggttcaccgtgctccagccgatgttctcctccccgtcagattcggagccaccgttggctgagcgctcctcatcccgttcaaagtcctggggcacaaaagaccagggtcggcccaggccccagccagcccacccagccgagggaagcagagggcggggccgccccagacgcaccatgagctcctcctgctcctcgcgattgccagccagcccgtaggtggggatctcccccaaggtgcggcagaactcggacgtggcgttgaacacgatggcccccttccgctcgggatcctcatcctcctcccagccccgctggcgagactccagcttcttcacaatctccaccacctgggggagggagcggctgtgggcaaacccagcagtttctggggtgatgccattgagacccaggaacctaagggtcctccctggcagcagccagacaggccacgcccacagcccatgcaggcccagctgctatctgccgcctaactccactctgcacctctttcactggggtcactcttctgctccaaacccatcaatgggtttggatgccctttgaatgaatacccaacatcctacagggccttcctgaccaggcctgtgccaatccccctccaaagcccctcacacactacctcagcctcaaactccttcctccaggctccctcctgccacctgcccctcccccgacaaactccggtttcaggactctagacagcacttctagaacccgcagggtggtgaggtggcccacgcttttgacttcccacagcccagcttctcgcttcctgcttcaccaagaaagcaggttccgtgacatgggaagagaactcactcatgctgccagcactgaatccagcgacccccacacgggcaccagcaccctctgctttccctcctgtcgcagatgcccagccacacacaatgattaccatctcccctctttaaaaaacttctccctcaaccctgcagcccagacagcaaagtcctcactcctcagtgaaggttcgagtcactatgtccacttctgcacccctctttcattttatattacattcatttttttaaaaaaatcttctgaggcgggtggactgcttgagttccggagatcgagaccagcctgggcaacatacccaaatcccatctctacaaaaaacataaaaattagacattgtggtcacacacgcccatagtcccagctactggggaggctgaggtgggagtactgcttgagcttgggagatcaaggctgccaagatcacaccactgcactcaaaagagtgggcaagagtgaagccccgtctcgaaaaaaaaaaaaaaaaaaattcttccaggggccgggtggttgctcacatctgtaatcctagcactttgggaggccggggctggaggatcacttgagcccaggagttcgagaccagcctggacaataaggtggagcacagtctctacaaaaaacacaaagatcagccaggcatggtggtgtatgcctgtggtctcagctacttgggaggctggggtgggtggattgcttgagcctggaggccgaggctatggtgagccgtgatcttgccactgcactcaagcctgggcaacagagcaataccctgtctcc

SEQ ID NO: 794 - DNA, 2780 bp, Homo sapiens
acttcctgggggcggagaggacctcagcggctgcggcgacacccagggaaggcggcgcggccgggtcccgaaactcctggctgtttccatcagagccctcggacactcccagcccgggctgagcacgcatcgtcgctccccggcggatacaagggggctccgccatccgctcccgtcagttcggcctccatctcctgggacccgcgccggcagccaggccaggcctctgagtggccccagagccctggctggactcgtccacggcggcagcgatctgcccggggtctcggaggccatcccttcagagtcggccctgtgctcgccaccgtcacctgctggttggattccggaaacccactgtctgaagaccacagaggggtgtcgctgaccaccccaaatcggatacgtccagacctcaagctcccttcccctctctggctgccctctgctcttttcatctcttctctcaaccttttggggatttctgtgtcctgacaccacctccccatccaccaccaaagtagccggggtgagccccaaaccttactgggtgtgctccacctgtgcctccaacccagcgaatctgacagcttcgacccaattctgcacacacccaggaagttctgccttttcttttctttcggtgtctcctgtacttcccaaaatttctcctcctcctgtgccctcttcgcccccctcctttgggggccccgtgaccctgaatgtggggggcacactatattccaccactttggagaccctgacccgcttcccagactctatgctgggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccggcactgaggatgctgttctcagtttgactgtggggaggagagagaatggggtactagcacccctgaagcctctttccagctctgcttcaggagctatgagagtcgggactctcctgcacctgactggagctcagatgtgggcaggaattcccaaacctgagcccaccaaggactcacaagtggtccagaaggtctcaacctgtgctgaccctgggaggggtagggaaggttctctcagcttgttcttgcctaaggctgagcacctccagtctctccttgatttggagctcagtgtttaagggcttggaaaaggggggaacatctctttacccagactagacctagcaaaaccctggaaggatattgaggtctggggaaaagggaggactttgcattttcccaatgcggtctcttggaccatggcttctactcctgaagctgggtggcctggcctggcctgaccaatgagaggccagaacactctggaacatcggaagaggagttctttgctatgttccaagccatctactgagggaggcagaaaggccacaacccaccctaggttgatgtatgggagctaggacagtccccatggcaatggggctggagcatccctcatctggaagaatcccatactgatggcagggctggccagggggaagagggtagtatctgtgggtcctggcctttcttcatgtgtgcgtgcatatcagcccgtgtggctgactgatgtataggtccctggcatcctggttcatatctgtgttgctgactacagtgtctgtgatgtccgcatgtccaggcctgtttggggttgcctagcgactcttctggcacagggtgtgtctgtggtatacctgtgaggtggttgacaattagtagtttaatcacagggtgtgtgtgtgtgtgtgtgtgtgtgtgtttatgtgcacgcatgtatatgcatcaccacgtagccaggaggggcctgttggggtttgagtcactgggatcttcctggtgagaggtaagagaagtcactgggcttagctgggcctctgaggcctgtatggaactcttggttgctgaggcaaccatggacctgttgctaggagatagctggggaaggcccaaggccgcccagggcagagagaggagacgaagagtttgggacagtgggggaggagatgggaagggatgggatttctgggtcccagagcgggtgggatactcacgcacagcttcttcactggtggggggtggggcacacattatttctcactggtcatgatttacaagaagaaaaataaaactgcttttggaaccac

SEQ ID NO: 795 - DNA, 2305 bp, Homo sapiens
ttaaaaaaatgtcccacgtgtggccgagtgccacacccaggcagctgccgaaaaaaagcaccagacaccatgcagctgggccccagggcccggcccaacccggttggccttctccagcacctgcagggaacttgtcctgtcttgtctctgctcgccccctgctggctgcctggagccattccgtgctggtttcttcgcgtcttctgtcaggagagagatgctgatgcttactcagggatccggcgggatgggtctcatctgctgcttgcaccgaggctccagcgacatttttactcatggtcaactgcgtcccctgccaactgcccttcgaaggacaggcgccacatccacctgccaggcctgcagcattagcaccagctccactagggccacagatgccccctcctctgtgtccagcccctgcaaatgcaccaagtgccttagaccatggctccccacctaggtggggaccctcagccccctcccctccatttctgagccctcacagccagagccttggcaggagaaggaccctcaccaggcacgggggtgccggggaccacgggagggtgatatttgggccctctgctccctcccagctcccaaacctgggacaaggctgaaaacccgggtcccctgggatgcctgcattctgggcaggatccccaccagtgctcagaagccctcgctttgctgtcccctctgggaaatgcatggggtgggacaggtaggagtggctcttcccctagatgacctagctagcccttcgacctgcctactccccacactgcctcacctggaaagccgtgtcctgctggcctcactccttcctgcagggcctggaggtggggaggccagaggcagggcagtcacaggctgggtggagctgccagggcagggatgtggggtatgctggccacactagcacatgctgcaccaggagcagagccctgcaccctgcctagtggctttcccaagagaaacccctctgggagaccctggctccaagccccggcctctatagtaatatgcccctcggggatctcctggtctggggcctgattcccaggaatgccagtgggttttttgtttttgtttttgaggcagggtcttgctctgtcatccaggctggagggtagtggcgtgaccagggctcactgcagccttgacctcccaggctcaagcgatcctcccagctcagcctgctgaccagctgggatgataggcaggcaccaccacacctggctaattttttaaactttttgtagagatggggtctccctatgttgcccaggctggcctcaaattcctgggctcaagccatcctcccaccctggcctcctatagtactggggttacagatgtgagccacttcgcccagctgaggcatgcctggtttcaaaactatcttcagctcttaatgttggtgggtgtaaaactcatcccagcgtggactaaatcacaggccctgcagagttggagggctgagaaggggcagctctgaatacaggggatctgcccgaacctcacttttcctggggcccctctccccaaccctggggccaccaccgtgttgcttccagagagtctcgctctccttccctttttccgcccgtcccaggctggatagagtcccttcctttggtcctgtcttgcatctgtcttgaattaggcagggagttttcaggaagaactttcccaaatactaagggagaacagagaggaaatcctatgaaatacagagtattcatgctggcagtctcatgaaggataggtatcaacttttgcgacaaccataggtacccccccaaatggctattacaagtgggcaccttgagcataacacgggaaccccacgcctggcctccatacctcccaggtcctgcacttctccccagaggtgggccctcttccccctaaagcacagcgccttgtgatgcgaaggccgaggctgggagaggtcacacctggtctctccacatgttccagctcccagcctgctgagcacagcccttgctgacctgggctggccctgaggaggggtgtgcttgctcccgtacacaggagtgacctgaaggcccctcactgcggtcacaaacacagccctaaactgtccagaaactgtatcctcagagcgggaagtgcccacgtggacagagagaaagccagcctctcggggcagattgccgcctctactgtgaggattctccaggggctaccgagaggctgggctggtttatctcctctgcctagaaaggcctggggtggccaatgtgaactcattaaaaggaaaaccagctttccc

SEQ ID NO: 796 - DNA, 2052 bp, Homo sapiens
gttccgtgtggatttatgaagtggtcacatctccccttccagataaagcttggcagagactcggccacccagggtcacatttcctctgcagccaagcgcagagggaagattctccaatgtgggtgtgcaaataggaccaccagtggggagcagaggccgcttttccagaccaagaggagtctagactatcactcacacattccctggtcatctggggccgccagaattctgagagtgcttcagtggtctgaagcagtggatgcagagattctgaaactgggcagaggttccagaagacaagtcatttttctagacctcccatagacgccatcgttgatcaagccattttcattttcacgaagtattttattatggaactcctaaagaccatcagccctacctggcactggctttctggttgaaaagcagcattgtggagcctgaaacatcatcagaggcaactgcttcccctccctgtggatttaggaccgctatgtgcagaggtctgtattagagagccagctagagtagccagcagtgacataactatgtagggagaagacacagttgtcaccttgaccccactggatacagaaatgtcaatggaaaaacaaattctgcatctgctgaattgttctgtcaatgcttgcactttcttgtcatttactatatagaaagaattattagtatcttttatttgtcagttattgatccaccttttttttttttttttttttggtggcagttctcctgtttgttagtttgctgtcccagttgaattctgagtttccgggaatccctagtgcaatgagaaatgatggagaaccaattctcattatctgatgaaggaaagagccatgtacctacaacagcaaaggctcagacaagccttctcctgccttgggttcatggtcacgtgctgtaggtgtcttgtcttcccatgtgcacctgtctgcatcctcatggtgcatcctcaggatgtcccgtacagtgtcttacctatggttatgcttttataacaatgtgctaataaaagcatggattacaaaacaaaacagaagatatgggtttccttgttgatttagatatgcccaagctttctgggttggaagactgtagtgtctggactgtctggagtcaaagcagtgttgaatctataacagcaagaaactatttcagcagagccagatgtcaggttctgggctgagctttgatggaaactaaagacaggacaagaggagtttgcttcccatgcagaggaggctggaatattgtacgtgagtgaagtgatgagctttaaagattcatccgtgctgttagcccactgtatcaaatgctggattctttcattttgactttttaagtttctttttagtggtagttgggagtggaggtggctagtgagaagagaaagactttttcctttttgagcacctctttggaccatttacattcattgacagctcagaagaatccaacagggtccatcccctttctccctggagaggacgcggagctgtgtatggctaactcggacctctcagctgtccggggcacaatgggccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaaggtgaaaaccatccatttcttggagaagtgccacggtggggttgcaagtcccaggatcaagttttcgatgtgtctctttttcccgtaaagtggctgaaatctgaagctgaatctgcaagtgtcatggagtcattgaatctcacagtctcaactgataaaagttattaaaggtcgtctggttcagccttct

SEQ ID NO: 797 - DNA, 1963 bp, Homo sapiens
aatattgcagagcaacttgaaagggggagctggccgcgtaggaggtgagagccagccgcaaaaatccgttcggcggcattttctcttcaaacccgcccggtcggatgtggcatttgaagaaagaaggcgtgggtcaataatcaacccgcactttctcctccaaactgctgacgcgactctcaccgccttctcagctaagccagctgccgggaaggccagctctccgtaagaacctgccaggggaagggattctctgggccaaggggaccgagggctcccgagcaagggctggggcgccctgaaagcatacctttccactggcgccaagaccctgccgggcaaaacgcggggaccagacctgaggagccgtgggagcccagggagatctggggcgggagcttcgttccggccagggcctctatccgccccgatacgtggctcctgggccgcgggcctcagcgggcagaagtggggctccgacctcaagatgaaggtccagcgtcctggcatgcagatggtcggtgccccagcctcaagccgctctgcttaaatccaaaggactggctttggagcaagcgtaggcgagattattttaaaataataatttatgctggcggaaggtttttatttgttggtttgctattggtgttttgttttttaagcgaaaatgccgattgttgatttccacctccagaaattaccagccgccgccgctgcgccctttctagacaaatcccacagcagttcacccggctcccccaaaaccgcagagcttttctttactgagaggaccccttggttccaccaattcccccaaatccccgtggctcccgatctctcatccagggggactagaagaaaagattttctcagcactagaagaatacttggagcagcaaaggtgcccgtggtgtctttctaccattcaaggggtgtcctcctgaaggcgtctgagagggcctctggcggttccaaggctgtgcagccggggaggaaggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgtagcggccgccgcgcccgtgcccgtggcctttacttgcttttgccctgaagttcagtgtagtggtttgtttggggcttgcaggaagaaacaaacacactccctctgactctccacaacccatctttgccttctgcaaccgcttctcctgcccatcgctggttttggggtaggctctttgtctgcctgaggccccgcactcgcagggcaagaagcttaaaggaatccaactccaaactcctccgaagttaaatattgaccagaacctctttcaacaggccgcggttgccaggaaccgtggagggccaactcctcccaaccgccctggtgcaaagtcccacgcggcgaagagttttggagcagcgcttacctagaaagatgtttaaattctgaaccaggaattgtctccaactccaggcgctcagggaatcgccttttccggtgtccaggcgctctgcagacaaataaacagcagaaggtgaatggcggctgcgagggaagggagttggaggccgggagtgggaagcgaggctcatgcgggcgccaaggtggccctgggggtgacgcgaacatcagggagtcaccagggcactcgtccgtgtggcgcactcattgctcgaaatgttccagtctacaaatggtccgaagatggtgatttatttttgtaaaataaatacatactccatctccacaccc

SEQ ID NO: 798 - DNA, 2354 bp, Homo sapiens
attcctggcgaccactgcttctgtctctgtgaattttgactattctaggcacttcacaaaactggactcatacgatatctgtagtttttctctattgaattcttaaaggggggtgggaactaagcagatcacaagggagctgcccacagaggtaaagacaaggtcaggtaggctgagagacgcaggaaagcgggtcaaggcgtagggctggagggcaggggcgggccctgggcgtgggctgggggtcctgccccggggcgcaccccgggcgagggctgcccggaggagccgaggttggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgtgagttccgtgcccaggcccgcgactcggtccaccaggacagcgctccgggtcgacggggtcctggagccgcgctcggggagggcgcagcggagggcgagcggcggcgttaggacccggaggcgcgggcggactgtgggcggcggggctaggacccagcggctctggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttccccgccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcag

SEQ ID NO: 799 - DNA, 2351 bp, Homo sapiens
tttcgccgccgtgcgccgcgagagctgcagctgcgccgccgccctggcgcaggccacgcccgcactggaaggtccgtgtggccgccattgaagccacaggcgcagtgatccattttggcaacgggaagtccgtggacgacgtgctttcccattttgctcagcgactgtttgatgacgtcccgcaggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacagggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaagctcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccactctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaac

SEQ ID NO: 800 - DNA, 3037 bp, Homo sapiens
aaccagcaaaacaaaaaaatgattattaccgaggattcattgcccagcctagaagccatcttgaactattccattttcaaccgtgaaaatgacctgctggcccagtttgatgccatcccaggcaaaaaaggcactcgtgttctcatttggaacatccgcagaaataaaaatggaaaatctgagttggactttgatacagatcaatatgacatcctggtttcagactttgacacagaagaaaaaatgactggcggtgttacctctgagctaccagaaacagaatattctttaagggcattttgtggtattctatacatgaagccacgcatgaaaatttttctgcgtcaaaagaaggtgactacccagatgattgccaagagcctggccaatgtagaatatgatacacataaacctaccttcacaaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcattgatgaagacctgtgcttgagcaaagctaagaaacaagaacaaactgttgaggagaagaagaagatgcctatggaaaatgagaaccaccaggtattcagtaatccaccaaagatcctcactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaag

SEQ ID NO: 801 - DNA, 2317 bp, Homo sapiens
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagtatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcgcatctccgtggtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatctccgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctc

SEQ ID NO: 802 - DNA, 2090 bp, Homo sapiens
agttgtgtagatcgctgagagactacgagggtccggttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgct

SEQ ID NO: 803 - DNA, 2491 bp, Homo sapiens
ggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccggccagatctcctatcttatgaggacttggagctggcagtgggtcacctgtacagactgagcttcctgaaggaggattcccagagttgggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctggactctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 804 - DNA, 2430 bp, Homo sapiens
atttggtttcttccttcttgatcatttggtgtttaagtaaaatgaggcacaggcttgtttgccgagtggagtgggaaaggcattttgatttgctggcctaattaaaaaatgataaaggattaaaaggaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgccgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgac

SEQ ID NO: 805 - DNA, 2242 bp, Homo sapiens
gatgctgggcgagagagagccgccgcgccggagcctccttctttcctgcctctgattccgggctgtcatggcgacccccaacaatctgacccccaccagctgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgagaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggagg

SEQ ID NO: 806 - DNA, 2365 bp, Homo sapiens
tctaaattttgctgaaaacaaaatgaacgaatgaatgtatatgatccttacaggctgacaaccagggctacaggcctaaagctcacaagcaacaagtgttggctggacacagtagggattcaccacctcacatctccatgtcattctaagtcgttttttaacgaagtaaaatctatcatttttaacgcacaaaatgaaagctatgcacacttctgagctgactttatcagaaagtcatgaaaaacgagaccagaaagaagtacacacagaagctacaactgaaaaagataaaaagcatcagtcaagatggtgaaaagaatcattagctcgccaggaaagacacgcaaccattgcatgtggtattggcaggagagcctctccacgtcagcgctccgtggacgtgtggcctcgccttggcactcaggctgtggcacaggcaggcatctcagtcccacccatccagggagcactccaacctggctgacctcaagggcgggggccatctgggcatcagccgtggcctgtgagccaaacggtcactggccctgatcatcaaactgacgtcctgcaaacccacccagccacccccgcggttacctgtgaatgatgcccttgccgtgcaagtactctaaagcagacacaatctcagccgtgtaaaatcgggtacaggtctcatcgaatgaaccgattttgcgaatatatttaagtagttctccatttttggcataactaaggccgaaatctgaatatcgtgcagttaaggaagtgtaaaaatctcttgtttcgttttggagcaggtttactccgttgcccagactggagtgcaggggcacaatcatagctcactgcagcctcaacctccctggctcaagcgatcctcccaccttaaccaacccaagtggctgggaacgtaggtacgcgctaccacgcctggcctaggagaagccacagcaaaccccacgttccccgccacaaagagaaggaagtccagagtcagtgccaggctgccacggctcaggggcccagcccaccacagcctttcatgcccccccacacactcctgcccaggagctgaaagagccccacactgccgccagcccctacccagccctaagactcttggcagcacatcttgctgccgggaagcctctgacacggatcgtcagtgcacgtccagctcctccaccaaaatcgaagcttctcgtgggcagagacaccacccggcatagcagcgcatccccatcacccatcaacctgcacttggcaagcacctccaaacagagagagcacacacactccgccggcagccgaaggagctgcaggatggtgctgagagtgggagcaggccagaacgaagctctaacacagaagagccgggtgctggggagagacggggaggacaggtgggaggactcaggcccctccccaggcaggatggggaggccacgacacttgggccagcttggagggtggcgggggaggagaagagcagatgcagactgcacctgctgggggtgacgacggtgcggcgtggccagcccagccactggcaggcccacaggtcagctggatggggcagaggtggggcccaccccaacttccaccgggccttgcctcccagattcctgagccaaggtttaataacagaaaagatggagctctaggggagcaagggacgccgaccaagcaagccgcagcagagaggactgtgctggagccacatcggtggcttctccgggaggtaacgtcctgtgcagactcccagccacaccctggcgctgcctcggctgcctccctgaatgtcagcggcctgagggaccccactcggcagggagcgggggctgcttgtgggaacacacagggtctgattccaagtgagaggggtgactggtgtggcttcagacggcaccaaccacgcaaaggatacacagcttctcgtcgtcctgaaatgtgaagtaaagcttaacaaagaaggggtgatccaggcgcgacatgacatcccgctctctggttacataggggaccttgttctcttttatgatatgtcgcttctccagaattttaacttcaggtgagagagaagtgagttactatcagaaacaacaaaaaacactaaagacatgactcacaaaggtaactggtacaaattaaagtctttcaaacattgtacacaacagcctggtggtctctaaagccaacagtgtcctgtaccctgaaatcagcacagaaacaccggccctgccaccccagccgccctgcacggagccgcttgccctgctcccggacgcacagctccctgcagcccatactcactcgcatattctctggaggttgccagttctcgagccaggacaacctggttggg

SEQ ID NO: 807 - DNA, 2617 bp, Homo sapiens
gacttgctccggtttgcagagctaggaggtggcaggctgtgcgctcaaactcaggctgtctaactccacattctgtggggtgagaggatgggtgatggggtgtcttttctggaggagggaggtgctgtgagcctagcgagatggaggtacagtgggtgtgggcctggagcgctgggcccaggcaggggcttctgattaggaagccctggggcaccagttcaggttctcccagagagtagtgtgatgggatccagtaacctgtgccctccagatgacttctgtaggtgtgtttagtgacatgctcaacgggtgcgggaaggatgggcttgtgccaagggccaagcccagagatgtttcagatttttccctttatgcccctgcaaccaagccctgctgctccaggacatataagagacgaaggctgagggctccagcactcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcgcgacaaggtgcctgctttgggggtgctggaggctttggcactggtggctttggtgccggcggcttcggagctggtttcggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccagggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgccgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattc

SEQ ID NO: 808 - DNA, 1116 bp, Homo sapiens
gttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagag

SEQ ID NO: 809 - DNA, 2269 bp, Homo sapiens
agtataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacgctcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaaccagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactag

SEQ ID NO: 810 - DNA, 2304 bp, Homo sapiens
agacgccaaagctagaaaggggtggaccctggccccgcatagctctcgctgccaccgctgctgccactatcgctgtcactgtcgctgctgcctctgtccagctgaaatgaccgtggggaggcctgagggagcccccggaggcgcggaggggagccgtcagatatttccccccgagtccttcgcagacacagaggcaggagaggagctgtccggggatgggctggttttgcccagggccagcaaacttgacgagttcctcagcccagaggaggagatggattctacttctgactcaactgggagcatttaccagaacttacaggaactgaagcagaaaggcagatggtgtctgttggagtctctctttcagtctgacccagagagtgatgaaaacctctctgaagatgaggaggacctggagagtttcttccaagacaaggacagggggatggtgcaggtccagtgcccgcaggctctgaggtgtggctccacaaggcgctgcagctccctgaacaaccttccctccaacattcccaggcctcagacccagccaccctcaggctcccggcctccctcccagcacagaagcgtcagctcctgggcatcatccattactgtccctcggccattccgcatgacgctgcgcgaggcccggaagaaggccgagtggctgggctcacctgcctcctttgagcaggagaggcagcgggcccagaggcagggtgaggaagaggccgagtgccacaggcagttccgggcacagcctgtgcctgcacatgtctacctgcccctctaccaagagatcatggagcgcagcgaggcccgaaggcaggcagggatccagaagaggaaggaactgctcctctcttctttgaagcccttcagcttcctggagaaggaggagcagctaaaggaagctgctcgacagagagacttggcagccacagctgaagccaagatctccaagcagaaggccaccagaaggattcccaagtccattctggagccagcccttggggataaactccaggaagctgagctcttcaggaaaattcgcatccaaatgagagccctggacatgctccagatggcctcttcccctatcgcctcctctagtaaccgggctaacccacagccccgcacagccacccgaacccagcaggaaaagcttgggtttctgcacactaacttcagattccagcctcgggtgaatcctgtggtccctgactatgagggcctttacaaggccttccagagaagagcagccaaaagaagagaaacccaagaggccactcgcaacaagcccttcttgctgaggaccgccaacctgcgccaccctcagcggccctgtgatgctgccaccaccggaaggaggcaggattccccacagccaccagctacacccctgccaaggagtcgttctctgagcggccttgcttccctctctgccaacactctccctgtgcacatcacagatgccaccaggaagagggaatctgcagtcagaagtgcacttgaaaaaaagaacaaagcagatgagagtattcagtggctggagatacacagaaagaagtctcaagcaatgtccaaatctgtgaccttgcgtgcaaaagccatggatccccataaaagcctggaggaagtgttcaaagcaaagctgaaagagaaccggaacaatgaccgtaaaagagcgaaagaatataagaaagaactggaggaaatgaagcagcgaatacaaacaaggccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccaggaaagtactggaggagctgtctcatcagtcaccagaaaatctcgtatcacttgcttaatcactacacttaaaattactgcttttgaaaaatattaagcagctaacttgggtttgagtcaaggcagggaaaacttgggttttgagtcatggctactgttagaggatggacaaatgaagagtagcagattaacaggccaggcgcagtggctcacgcctgtaatcccaacactttgggaggctgaggcaggcagatcatctgaggtcaggagtttgagaccagtccagccaacacggcaaaactccacctctact

SEQ ID NO: 811 - DNA, 2591 bp, Homo sapiens
gcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcgccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtg

SEQ ID NO: 812 - DNA, 2420 bp, Homo sapiens
ggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcgaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccgtccctggaacagaaccggggcagggagcccgaggcctctgggctgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaag

SEQ ID NO: 813 - DNA, 2296 bp, Homo sapiens
tcgatgagcagcgatgccaccgcatcagcagccacgaggcctgccaggagcggcagagagagggacccacatccggaacaagagcctggagagtgggggccggaacagggagacaactcaagctctgcgtcctggggctgtgctttggccacaggcagagaggaagtcccctgcgagggggcgggtcccaggttccttggagttgcgcttggggaatgaaacgggagacagatgcagagaggctggggtgtcccaggaccctcggggctgtgcggcgggcacacggggtgctcctgaacacaggctgggggtcgctgattctgggactcggagaaggacacggatcctctgatttggggacgggaggtgggatggtgacctggagaaccactggggtgttctgggagcctctggccaagcttctggggtggaagtgatacctgaagtgccagggtaaaaggcagggagtgatgatctctctcctggagtcgtctgagctgcagccactgtggaaagagaaagaaggtggatgagggtggagagaaggtccacaaaacagaatgctcagcctggcaccgtggctcacgcctgtcatcccagcgctttgggaggccgaggcaggaagatcgcttgagcccaggagttcgagaccagcctgggcaacatagtgagacctcgtctctacaagaaatacaaaaattagctggaagtgttggttcacacctgtaatcccagttactcgggaggctgagctgggaggatcacctgagcccaggaagtcaaggctgccgtgagccgtgattgtgccactgcactccagcctggacaacagagcaagaccccatctcaaaataaacaaaccaaaaaatagggtgtagagaaggaaaggtagtgtcctgagaagtaatctccaggctggagagatggaacaggaccacatgggaaggggactcccagagacatggagagtgacaagaaattggaagtggcagcagagacccagccatgagaaggggacgctaacaggcagcccctccagaactccctgtctcacccccttccgcccccaaggacccaggccctgaagcagaatggatctcccagaagggaaggggtgcagggagaagaaccccactttcatcacccgtccctgcagacgtcacccaagcacccatctcacaaacgctctgcctaccatcccctgtaaccactggcttcacctgggagcaaaagcaggaagaggatgtgacccagatggatcatggtggactggggtctggcaggggtctggcagaggactgtggtccagagaagtccagaggaactgtgggggagcagagaagtagcaatagcggatgtcaccctgctggtgtcaaggccatctgcttcctgtgtgtgttgagggggtgtctccgttactgcctttggtgaacgaactcagggggagggtcagagagaccagggaggctgctggcctggtccaagtgggaatgacaggtggcaagggtgtgcaggctagggagatctggaaatattttggaggtagggccaagaaaatttgctgattagatgaatgtgggtgtgtttgagagggatcctagacagccaagccttctggcatgaaacgctgagaagatgggagtgtctgctggcagagatgaaaggtagggaagtgggtttgcggggaaagtgacgaggtttgggcatacagggttggaaatgcctgacaatctccctgtggagatgctgaataacctcactgcatttaggagttcaggggataaggctggtctggagatgtaaatttgggggttgatggcttatggatggtacttaaagccacaagactgggtgagatcaccaaggaagtgagtgcagacaggattctgcccctatcacaacacacactgaatgggggaagaggaggaactttgccagggaaatggagaaagagggaggggacccctgagagcatggcatcttgaaagcaggggagaggccaccgcagtggctcatgcctgtaatcccagcactttgggaggccaaggtggggggatcacctgagatcaggagttcaagccaatatggtgaaaccccgtctctacaaaaatacaaaaattacccgggcatggtgtcaggctcctgtaatcccagctacttgggagactgaggcaagtggaggttgcagtgagccgagatctcaccactttgccactgcactccagcctgggcgacagaatgtgaccctctctctaacaataaaaatgtaataataaaataaaatagaaaagcaagc

SEQ ID NO: 814 - DNA, 2169 bp, Homo sapiens
ctgcactgtcctccggcctcacgtggccttgtcttcacacccagcgtggtcatgccttgggagcccgtcacccacgcacgcctcagggtggagcccccgcctggactcaggaccccgggcaccagctcccgcgtgtctcagaggctatgcagacaagagtccctggactgggctgtgtttgctggggctccttccctccagcgacgagtccccagatcatctcccgggtgtgcctcagttctcaaaggtcctggcagcccctctgcgccaggcagtggccgcacgccagcagcctcctcccacagcccaggagctggaggaaacagctcagccaagccgcgccaccagctagagccgggactccctccttgacattcagagctgctaagttttcctgcgcacggttggtttgacatttgcattggaatggatttatgttaacttcctccctgctgctggccggagaccaaatcctgctggttgctcaggcagtgatccccggatgggccacctgcctcattgcctgccctgccagagggaggctctgggacctgagaccacccaggcgcagacttggtgctgtgtagctcatggagcggccccgcctctgctcccaccgagccctccagcccccttgtcttggaaggacgcagctccccttcctggccctcccccaaccccaagtcctcgcccaagcgctgcttcctctatgaagcttccctgagcggccctcttggagggtcactgttccctggcaaattctgaccacacctggctcctccatcatttcatggacgcagccctggtcagctccacttgggtcggggctgacgtggctcattcccttgcaccccagcacagcgcaggacaggctattcagctggtgtccagtccgcctgtgctgtatgctccctgcagccggagcagccaccacgcatccatccacccttccgtcctccctgagggctggcactgcctcccggatcctgccgcgtacacagcaggtgcagaatgggtgctcgctaactccatgggacgacggggtgtcaaacctgcagccaccagcttctgacgggagatttgctgagagcctgcaagtcccacgggcctactggggggctgtgcacagagagcctagggggccatggcccagccctggcactccccgcccacagcaattattgccccaggagccaggcccagcctgcacctccacaccggccctgctccttcctcctctaggtccaggccccaggagccaggcccagcctgcgcccccacaccggccctgctccttcctcctctgggcccaggccccaggagccaggcccagcctgcgcccccacaccggccctgctccttcctcctctaggtccaggccccaggagccaggcccagcctgcgcccccacaccggccctgctccttcctcctctgggcccaggccccaggagctgggcccaggccccaggagccaggcccagcctgcgcccccacaatggccctgctccttcctcctctaggcccaggcgcccgcctgacacatgtccaccatgttcaccttgcctgtgtcacacatgagaagactgagactcagtgagggcccagcagagcgggtggagctggtcagcccggctgtgccctgacatgtgggggtggggggtgtggaatcctaatgagggaaaaggagtcgggctggcaggacagagggaaggcaaaaagaagaagcaaagaagctttaagtctgcccttcttcactgtccaggacacacagccctcctgaagaaataactcacaatcttcctgtgcccggctattgccagacccttggctgataggagaatggatgttagctgactgcaaccttggcgttatcagtactgcctgtggccctctccagcacacagcacaggcgccgtcctataacatccccagtaagccctcatttctttgcagtggctcctcccttgctgacctgccccttgcttcggctcctcccttgctgacctgccccttgcttcggctcctcccttgctgacctgccccttgcttcggctcctcccttgctgacctgccccttgcttcggctcctcccttgctgacctgcccgttgcttctgtgctatgcacattttctactttctctaataaatctgcctttctttacctac

SEQ ID NO: 815 - DNA, 2578 bp, Homo sapiens
tcaaaaggacagatgcaggggacaggcgccaggcacagataccatctcccttccccaagccagctgcccccaaccctccccctgcccgcaattagtcctctggggcgggagcggggcacagagcagagccctcttgggggaggggaagcccgatccgcacccacccttcctttgcccccctcttccttctgctgctccaatatcaatttcagccagtgacctctccaccaatttgcacatccccactctcccggtccgtttcaccgccagacatcggttccatttcgaccctcactggcggtcattcccaccccctctgctggtcaatttcaccccttttggcggtcaagtgcagtcccccatttcccgggcaatttccccctcccctccttctccctctcccctcccctccccagcagtgtcactcccagctgctccccacctcccgcgctccgcgctcgctgcggccagtctcgggcgtcccggtcagtgtccagctgccgcggcctcggccccggcgactcccgcccccagccccccttccctccgcgggcagcggctccctccctccccagaacagctgaaggtctcagtcacctccgaggggagcgcagggggaggggaggggcgggggacgcggcggaggggaggtgggggagccttgacgctgctgcccgggacgcggcccggggctggtgggaacaggggcgtcctcctgcgcgcccccctccccagcgtcccacctcccgacggcggcggggaaagtctctccgaaagcgtgaagggggattggaggaggtttttatttccctttgtgcgggtggctggggccggatcgaggcggcgggagccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcgggaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgcccaccccggactacaccgagagcgacatcctgagggcctaccgcgcgcagaagaacctggactttgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggaggggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgtttg

SEQ ID NO: 816 - DNA, 1549 bp, Homo sapiens
aggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaaggctttgcccaggatggttccttctggaatgtctattcccctccttccctccctgaagctctttgtcagggacaaaggtaggatccctccccttccgtcttctccactggatgcctgtgtcgtattcatctgtgaccaccaggtactaccacagagctggagctgaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttct

SEQ ID NO: 817 - DNA, 2241 bp, Homo sapiens
tggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggagggcgcattacgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttccgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtc

SEQ ID NO: 818 - DNA, 2787 bp, Homo sapiens
aagaggatgccagatctgccatgatgccaggaagtgcctacctccaggggctgctgccaggcagcgggcaccactcagaggctccagaaacactgggtgacacccagggccatggaagagttggtccaggaagcagcaggcctgcaatgtacatatgcttaccacgtaaggacttttagctggtctgaccttgcggggccccttctaatttttcaggggtccccaaccacccttggcagctgtagcaggccctctctcagcctctcctctgggctccctggtctgaggcaactacggactgccacctccgtttacctccaagtgtctgccctggggcccttcaccttgtggggctggccgtggttggagggcagggggcgctggccatcagggagggagggagaccacattccctcccttggttgccacgtgggaacaggaagatggtgaaaggccatgatactgaggttcaccaatatggtgaactcttccggccagcaaaggattctggtcaaggaggtggagccaccggcccggcctggattttccaccccacaatggtaggccaggcatccattccaaaaaacatttcctaagctcccactacatgcccagcctggggccctgagatctgacagtgaataagatgccctggcagagctcagatctggctggagggagcaggagtgcggcaggaaggagaggcccccgtggcagagcagccaggggcagacagacagggctcacatcccagctctgctcagtaccagctgcaggtcttgggagaattcaatccacctctccagcctcagttttgtcttctacaaaagagggtgacaaactcagcctcacagagctgctgctggagggaatgagacaagatgacaggagggccccgtctggcaccccttggagttccttccaggaacgaggagcgaagagcaggcacctccacccgggttccagcacaggacacttgcaggggcctgagctgcagatgggagaggcagctctctggggacagagctgtagccagaggccagcgcccggggctccaagaaccacaagtccacagcaggaaatcctcctccagagcctggagcctgggtgcccgggtcgccacactgctggctgctgatagtgctgggtgaatgtgggcagtcccttccccagtctggagtcccccttccgcctccgtccagcagagctcaggcgctggacaccaacgaaccctccagcaatgacattccggaaaaacggaaagccctcatgatcccttcttgcaggtgggaaattagaggcctgggaaggacagtctattcaagggcacacaagttcacacagcagagtcagaagtagaagccagatctcctgactccaaatccatagcacctgtccacactagtacctctccaaaggcatgagccagagtaccaggaaactcagaaggtgtggcttcttctctaagggactccttgacaaagctctcagctccaatgaggtaaccagcatccccctccaaatatcctccaagatctagagaagtcactcctttgttcaagaaccttccacagctctccatcacccagtgaacatctcacccagcatccagggtcccaaccttcctctccagcggctcccgctcattcccccacctttgccttccatcctggtcaccacatagtaatgactgtccccatctcctggcccttctgattctggtcccccatcctagaatttccctgctccttcctttaagaccatctgaagatcacctcctccaggaagccttcctgctccccaggttaaacatggcctctccctcccctaggctaccagaggaggtagcctcaggctgtatctgggtacctcatgtgcccatctgtctcccccacgagatggggaaatacctgggtgcagagtttaagaaacgcccacttcttgtcatcttctcatcctctgcgccaagaattgaaagaggaagggctaagtgactcctggggccctgagcccacaacaggacgaataaacagggactgtttggtgcccatttgggacacaattccaggccagaggtggctagaggctgggcctggagcccaaacacaggcattgatcccgcctccaatggctgtttctgttttccttttccctgggcagtggctgcgggggcgttctgggccacagctggtttctattgcatcaaggctcaaaaaagccctgagcatatttttagagagaaggggaaaaaaagaatcttttcttccctgacccaagatgagggcttgctccaattttccatctgctctctcttctgggtggagctggccgggaagtttctctgcagggggatccttcaggatggcggtttgtgagctcatagttagggcagagtgagaggctgccggcacgatgcccgcctccctcgccgacacacatacaaacacaaatgtgcacacacacacacaacctcaggcatgtgatgtggagaggagagccacatgcctgagtaagaacagtgaaggagcaagagggacttggagccaccagtggctccagcccaatctcccactggaagcaggtagctgaatggtggcctgaaccaggggttgccgtactcgcactccagagccctgggatgtgccgcattcccactggggtgcctggatccagaagacctgggcacatctgggactggaatacagaacgtgtttgatgcatctttgaatggctggttttcaattgtctgaagattctgttgggaggaatgaaagaccaaatcatttt

SEQ ID NO: 819 - DNA, 2729 bp, Homo sapiens
aaggcgtggtggacctggacttagatgagcttaatgtctatgcccggggtactgactatgatatggactttaccctcttggtgccagccctcaagctgcatgaccgtaatcagcctgtgacactcgacatgcgccactcagccttgtgccactcttggctgagccttcggctctttgatgaggggacaatcagtaaatggaaagactgctgcaccattgtagatcacatcaatggtgccaccaactacttcttctcacctaccaaagtggctgactggttctatgactctatcagcattgtcctatcagaaatacagaagaaaccccagcgagggatgccaaaggtagaaaaggtggaaaaaaatgggaccatcatctccatcattctgggtgtagggagtagtcgcatgttgtatgatattgtccctgtggtatctttcaaaggttggcctgcagtggcccagagctggctcatggagaaccacttttgggatgggaagattactgaggaagaggtcatcagtgggttttacttggtgcctgcttgctcctacaagggtaagaaggacaatgaatggcggctgtcctttgccaggagcgaggtgcagttgaagaagtgcatctccagcagcctcatgcaggcctatcaggcctgcaaagccatcatcattaaactgctgtcccggcccaaggttattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagcaacttcattgaatgtaattgtcctcaaatcagagaacactgggtggtttgaagggtgtctttgacagttttccaagcagaattaaggtttccaaatgttaattttagcatatgtaattatttgaagccttatttaaatcctattaaagaacataccattataattattatttgcactaatctttgccattgtcagaattgcaaagtgtgtttcaatataaattaacaaccactctcgaaattctatcattttttcattttgcccatttctatcagtgaaatgattctttgcatttgcttagttctccttcagttgtggggtcctgctttgccctctttgatattcctggttcctgtcttactgagagaagttgttaaagctttatacatgttgaccccatctaaagctggggaaaatatacacttgatgaagtaggtgtctttgtatttatttcttttggggtcatagaggtaagctttttttgtaaaatctctactcttcctgagagttttgagaaaaactggcaggaagaacttataatccccaaatagaagataccacgtctgttcaaaagcaggtattgctatagagcagcacccaggaaatatctgtgggtggcagccttggtatagaggtgtcctgtcttcatgagtgaagttacttgcctgattaggtgctggaaggtattggctccctgttttggtgtggactcatggcaagctggtgtttaagaggtcaggaggcctgctgatctttcaaaggacacccatgatgtctactcatagaaagggcaagtaacgtgttcattttggtcttgaatgtccaaactcaagggttggattttggccaattgaaatcagacatatgcgatcttgggtttttgcatggaaattaatgtaatgcttataaatgaaaaatgaaaacatttcaaccatctaagtcaaacac

SEQ ID NO: 820 - DNA, 2383 bp, Homo sapiens
aggtcccaccgctcctaccagcagcctgacccaggatggctctactccccagccttcaatccctggacctgggtttggaattaggagacttccgtcgagggtcaattgtgcgggatcctggccattccatacaaaatctcacgactggcaaaagagagggggacacctcgagcagaggtcagatatcacaagggacccgggtttttccaccccgccctcattcccagcgtggggtctcagatgagtgggaaaacctcaaatatggatcagaaatcatgcaagttcggactctggccttaggagaaaactcttaacggagatggaatgtcacgagggatccagccacccccatccactcattgactggatgaagttttgcgatgggaaaatccaggtcaggagttacggacgacctgcaccgcccggagctccttctgggtccggagtttgggaaaagtgcgggttaggggttaaaggtcacggaagaacttccccactccccccgcctctttcgtccgcgggccggttcaagaggtattcggaaccaggggaggagagcggcggccatcgtacctgagcaggagccagcgcctgctggagctgctgctgctcctcgctgatcttttgcttcagtttcttgaacatggcgcagcgtacgtacggtcctgagtgtcaacgaaacctgaagggcgagagcccggggagtcccggccgcgacggctacggcgacttctttacaccagggacagcggggccgggcctcgccgtctcctccttgaggctgtgggcaagtccggacactcgtcctgagggtgtcggcgtcgccgccgccgcgtctctttcttccgggtgccactggctggcctcggccccccatccagccccgggagccgcggcggcgacgacaacggcagcaggtgaactgtgcgccaagggcgcttgcgcggcctacgtggagctcacagaggctaactacggagcaccggatgggacaagcacaatgtcgggtcccgcacatgcgcgctcggccggtcgcttccgaactcgctgcactggaggacgcaaggttcggtcctgcctgatttcgttgcgtgcggagaccgccgtcgcggctcagaaccggagcgtgggctagtctgaacactaccctgactctcacctgggctttggccctgcgaaatcagacggggagagtgctgcttctatcgatggcagcagggccgacgggcccaccgcaaagaacacagggatgagcgtcaaggatgggagaaggggagatccagagaacctgacgcgggccctaattgatagtgttcttttctttagtagctgtagctaggattctgtgtcttcggtgccagaggggcccgcttcccttccctgaactcttccagcgtcgggaagtccctgataccaggcgccaggggtccaaatgttttatgccaatactgtaaaacctcaagtgtttggacacctgctttattcttttcttcaccgaaatcgtgtatttcacgaattcattcaaaaacctttatcaggccttggagatgttaaaagaatttacagcctagtggaagacacagattcctaattagtccaaatttactcctaacacctgcaatcatcctacaagatcttaatgtttatgtgcctcatttatctaaaaccctgaactttggctgcctgtgaatcctcaggtccatttcagcaacccacttttgcatgctgtacctttgatatcatctgaaactgcttacattgtctccggtatcagaatctaacagtatatgctgatctccacgttctagcaaattttgtttaccagcaataataggagcaacctgctctcgagagtccatattctgatccctaaatgtattagagccacagtggggcctggaacactgccttaacacctgggctaagtcctcttatatctcgtagtgaacaccttatgtatgtaaggtgtccccagcccccgggccacaaacgggtaccagcccatggcctgttaggaaccgggctacacagcaagaagtgaatctctggcaagccagggaagcttaatctgtatttacagctgctccccatggttcacattatcgtctgagctccacctcctgtcagatcagctgtggcatgagattctcataggagctggaactactgtgaactaggcatgagagggatctaggttatgctccttatgagaatctaatgcctgatgatctgtcactgtctcccatcacccccagatgggaccatctagttgcaggaaaataagctcagggctcccaccgattctacattatggtgagttgtgtaattgtttcattatatattacaatgcaataataatagaaataaagggcacaataaatat

SEQ ID NO: 821 - DNA, 2208 bp, Homo sapiens
atacctgtcctcggagacgctgatgacgccctcctctttgggcacgatcacggccatattcaccacctcctgggacccctccatccgctgcagcaggatcggcttgcgggtcagaggcttgggctggatctccgccgccatcggaggagggggcgcgcctggggcgccgccgccaaccgcgccgcggggccgggctgaggagactgctggagcacggacacaggttgagacagagactctggctggccggagcggaacgccggaaaccggcgagcatagcctggccgcctctctcgggaacgactccgcgctccctgcttcaggcaccaaaaccgccacgacctgggatgcaagccggcgccactacaagaggagggggcggagcgccggggggcggagcctgtgtgggcggggcctgccgcagggggtagccgctggtgggcgcgagggcggctccacttccgggagggtggtgaaggaggaggggaaacctggagcaggaggcggggatctggtatcccaatgcgcgtgcgtcagtcccgcaagcccattttcacccctcccctccgcgactccccgggcgctgcagcaccactaggacgcatgcgctttccgttcctcgcggtcttctctctgccttacacacccaagggttaggctcctccctctttaacctcccgtgaacgcgcgtatacacacccctggggacgcgcttgccagacgccacgccccttcgaaattccctgaaaagagggcggaggtggggcggggaaaggagcgcctcagcaagaccggaaagagaagaggcctgcaggaaggaaagccgcccaactcgttgggacgtgacttggcatgcgcgcgggctacctggcctagcggtcttaacaatgaagcgcggcgggaggccgcttactgctcccaacatgcaccaggcccaggctgccggagggaacccagtggcctcctgggagtcgtagtttcttggagcctccgcccccttgtcctggaatgacctatcgcccactttctgcgctatgggcctgaggagctcagcggcctccagggccattggccaagtcaggacccagacttgcctctatgggaactgaggggcagcccccagctgagtaggacgtcaccactcctagggtcagactgatgctcggaatagtggcacggaagggacatgaaaaggagagaatctttcatacagacatcttcaagggagctcagagaacatatggggtgtctatcccctcgttttcttagatggctaaattacacagccaaggttactttagtgcaaagttagggctaaacaacccctccttccctccagacttgaacccaggcccctagtgctggcttctttccatttccccagcaatccagcctttttagcttgctccagacaacggacagagttactgtagttactgactgaatgttaggtgcctaccagaaggcctggcatgtggggttgatcgtgaagactaagctctgcttttttatcttgcccaaattcctatctaaggggtctggggagtcatggcctacaaaaaccataaattctcatcagatgggttttgaccatgtaggtcatgacttactttccagtctgactctggcgtaacaaggaagaaaatcaaaatgttttaccccaaattatatttccttgccatgccttaaaattgccctgcaaagtctcttgtgggaaaaatccacattctatatcccctttcccctttgttttccttccttccttcctacacccaggagataaccaactaagagccaggcaccgttttaggtctggtaaggaacattttacaacctgctgtctctaaaggctgctatctaaaagattcctctgcacaataaaacctggtctccacaatcctttaccttaacctgaacattcctttccgttggtcccaggtcttcagataaactcaaccaattgtcaaccaaaaaacgtttaaatttacctatagccttgaagcccccgctttaagtggtcccacttttctgaaccaaaccaatgtatttcttaaatgtatttgattgatgtctcatgccttcttaagatatataaaactcagctgtaccccgaccaccttaggcacatgttctcaggacctcctaagggctatgtcacgggccacggtcactcatatttggctcagaataaatctcttaaaatatttt

SEQ ID NO: 822 - DNA, 2374 bp, Homo sapiens
acctacttgggttcaccccctctggagcagggtctcaggttgggccacaggcccaagtccaggtcagggccgtctctttctcaccagcactgactctcacccacagtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggaattgcatctcgtgcctgcaccagatgcatccacgtggccggtttcttgtgtgttcaatgctgcgtgtgaccctgcccaggggccgactgcttggagggcatgcccattccatttgctcctcccaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtaccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaaggttggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctc

SEQ ID NO: 823 - DNA, 2703 bp, Homo sapiens
gttttactttgtctgctttgctaaggaaggccggtgaaccaggaccaccgcacacacaggcccaccaggggcaatgctcattccaagaccttaacttttaagagccctttgttccaacgttagtgtggacgatgctcttgcaggatgcctttccttttgggtcttagacaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagccctctgaggagcaggctcgagagcctgggcacccgcacctgccacggccgccctcatgcctgctgctgaacaccatcaacgagcaggactctcccaactcccagagcagcagctcccccagctagagcaggtcctgccagcacccagcaacttggcaaagcaaccagggtaggggaggaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgccgttgagccagaagatgtctcgtgtgaaggctggggtggcggctgtcttggaacctctgtgagcaggaggccctaagccgcagcagtggatagaggtgcagctctctgcctctctgccctttggtctatgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggtttttttttttttggtggcagttgtctgttttaaactgaccacttggaagaaacaccttggttatctgtggttttcttgccttgtccctgcctctacccccaccccttttgagtcgggtgactcatttttctgtgtagagactcggtggcccaggcaggaggtgaaagcggccatccggaaggccctggggacccttgtgcctgttgctcgccttcaggtcaccagctgagctgcgataggaaaatctgaatggaggcagcaaacagccaaaacaaacattccccacccggccctgtgcatatgaagtcgttcttcccccaactcttgaacgatgatgatattcagacgaagcattgatgttatggaag

SEQ ID NO: 824 - DNA, 2100 bp, Homo sapiens
atctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggaggagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccacgcccaccccctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagc

SEQ ID NO: 825 - DNA, 2451 bp, Homo sapiens
ggagtcagtcagaggggcgagcaggagcgattccgtcgccaaacaggttatgagtgccagtgagccgccttagatagaagcatcgtcagcactttattaatgatggatagtgagaataaacccgaaaatgacgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgat

SEQ ID NO: 826 - DNA, 2581 bp, Homo sapiens
tctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacggccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcggctcactgcaacctctgcctcctgggttctcctgcctcaccctcccgagtggctgggattgcaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactg

SEQ ID NO: 827 - DNA, 2316 bp, Homo sapiens
ggctcgacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagtgtttgtgaccaaaggaccaactatgtgattgataagttcgcaaagaaccttctcacctctatgcctcatgatgcaattatcttactcagaggagatttgccaggaaattctctccgttacatgcattactgtgaggggttgaggcctgacatttcattagtggatcaggaaatgatgacttacgagtggtatttacccaagatggcaaagcacctgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgagtgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttc

SEQ ID NO: 828 - DNA, 1776 bp, Homo sapiens
cacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaagaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacgtgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaaacactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgc

SEQ ID NO: 829 - DNA, 2264 bp, Homo sapiens
ttgcaacctctaaatgaaagaacttagctgctcagtaggaagggaatggtatgatatgagtattaagcagccatttgaaatgtttgcaaaagtgtataatgatgtttcttactgttaaatggacaaagctagctgtgaaattatgtctgtagaatctaaatgatttcgtagaatatctggaaggaaattttccagaatggtaacagtagttgtctctggctgatgtgtgattgtttttcttgcttctttagactttcctgtattttgcgaattttctataatgaggctgtaggacttttaggatgaggggataaacaaaggcagcagaagagaaaacagcagctgtcaggtgaaggtgggctagcacagaggctcagaaggtgccagtgggtggcagaagtgacctctcagggtattattagatccatgtactctctcctctgccctgcaggcctgccgaggaggaactgaagacgaagaacatggatgataacacctttgccatggagcatcctgatgtccaggagtcagtgggtccactggtagcccccacccctctccgtccatggccccagatgacacttcaggtttctgacgttccgatgactggccaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgag

SEQ ID NO: 830 - DNA, 2170 bp, Homo sapiens
acagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagaggagtctccagccatccagtggagaggggagcttttcttgggatttcccttgtaatactacctcactctttgcccttcaccgcagacttaaccatggcctccttcctgcagagttcttgatgtgagataaaattgcttgtctttcactggaaactcccagaaagaaaggctggtgcctggtctctcctcatttccctgtcatgaacacctcgcccagcacatggagggtgacttgcgatgatatatttaaaaaataactcccagttctgagaagagccataggagtgttggctcttattatctgtcctgatttccatatgttggttgttttctattgcaaaagtaatatagtgtaatatagttcaattatagaaaacatggaaaaatactgaaagggtttaaagaagaaaataaaaatgacttaccatatctctactcaacttaacatttcagtgcaaatccttcctgtcattttatgcaaattaaaatttaaaacctaatttcaatcttactgtaaagagtgttctgtgactcgcttttctgatattactaaatagtgtgcacattttcccttgttaaatatgcctcaaaaacataatgttaatgatggaataatgttccatcatgcaggtggacctcaatttagcttcctgcttattgttactggacatttgaagctgctgtaaatctttgtcaataaatctccatgaatatccctgaccttagcataaaatcctggaaataagattgccgggtccaaagatctacccaaattaaaaatggacacaatttcaagaagtgaattgacctctaaaatagtttacaaatttatattaccaccagcattgaaaatgccttttccccacggattggtctacataagagtgttggttaattttatgtgttgacttgactaggctaaacgatgcccagatagcaggtaaaacattatttctgggtgtgttcgttctgtttctctgggatcccagactaacacaatcatatactttttgaggatgatgatgataacaatgaatgcctgcaacagtgcctggtacacagttgatcctcaatagatacttgatgaatgaataaaatgttctttgtcaagtgtcattagcaactgttgctgtggatgactttgaagtaggcgtgacttggtggatgtagtcaccctctctgggatgccttacctctctttcccttgacctatttcaatcatacatattttttggggctccacatccagctttcatcttccatcaatgccttctttgggcatgccagcccatggagtgctctcccactggcaacatcttgtagcttctgtttttagcactgtagacacaacattatgtggtcatgccgttgtttttcaagctgctgtggcacagtgatgatgtcaaaaatattatacataaaagagttggccaggcatggtggcttacgcctgtaatcccagcactttgggaggccgaggtgggtggatcacgaagtcaagagttcaagaccagcctggccaacatggtgaaaccccatctctacaaaaatacaaaaattagccaggtgtggtggtgtgcacctgtaatcccagctactcgggaggctgagatgaagaattgcttaaacccaggaggcaaaggctgcagtgagccaagatcccgccactgcactccagcactccgctctc

SEQ ID NO: 831 - DNA, 2749 bp, Homo sapiens
aatatttctacggaaggcgctgcacagactagcaaaggctgtttcttttacctgactgaggtcactgcatcagctgaaggcagacgatgtgcttaagcctgagtggagcagagatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataaggaggtaggggccataaaactggagctgattcctgccaggccgttttccagcagcgagctgcagagggacaaccccgccacggggcaacagaacgcggatgagggcagcgaaaggccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggaacgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgaggaaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcagctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatc

SEQ ID NO: 832 - DNA, 1868 bp, Homo sapiens
atagacactctgaactgcatgagatggtatctcattgtggttttgatttgtatttctctgatgatcagtgatgatgagctttttttcatatgcttgttggccacatgaatgtcttcttttgaaaattgtctgttcgtgtcctttgctcactttttaatggagttgtttgcttttttcttgtaaatttgtttgagttccttgtggactctggatattagatcttcgtcagatggatagactgcaaacattttctcccattagaactgtaaccctcaaacagggaattgcaactgaaatggaacatccaacccatatccccatgaggtatgaagacagtgaagtcaaaggatgtgagcattcgagagaattcagtatgtatccattggatcaaacaaggtaaaagagtgaaagaatcctggagggatcatgctacctgacttgaaactatactacaaggctacagtaatcaaaacagcatggtactggtaccaaaacaaagatacataccaatggaacagaacagagccctcagaaataaagccacatatctacaactatctgatctttgacaaacctgacaaaaacaagaaatggggaaaggattccctatttcataaatggtgctgggaaaactggctagccatatgtagaaagctgaacctggatcccttccttacaccttatacaaaaattaattcaagatggattgaagacttaaatgttagacctaaaaccataaaaaccctagaataaaacctaggcaataccatttaggacataggcatgagcaaggacttcatgactaaaacaccaaaagcaacggcaacaaaagccaaaatagacaaatgggatctaattaaactaaagagcttctgcacagcaaaagaaactattatcagagtgaacatgcaacctacagaatgagagaaaattttgcaatctatccatctgacaaagggctgatatccagaatctacaatgaactcgggcaaatttatcagaaaaaaacaaacaaccccatcgacaagtgggtgaaggacatgaacagccacttctcgaaagaagatatttatgtagccaaaagacacatgaaaaaatgctcatcatcagtggccatcagagaaatgcaaatcaaaaccacaatgagataccatctcacaccagttagaatggcgatcattaaaaagtcaggaaacaacaggtgctggagaggatgtggagaaataggaacacttttatactgttggtgggactgtaaactagttcaaaccttgtggaagtcggtgtggcgattcctcagggatctaggactagaaataccatttgacccagccatcccattactgggtatatacccagagtattataaatcatgctgctataaagacacatgcacacgtatgtttattgcggcactattcacaatagcaaagacttggaacaaacccaaatgtccaacagtgatagactggattaagaaaatgtggcatatatacaccatggaatactatgcagccataaaaaatgatgagttcatgtcctttgtagggacatggatgatgctggaaaccatcattcttagcaaactatcgcaaggacagaaaaccaaacaccacatgttctcactcacaggtgggaattgaacaataagaacacatggacacaggaaggggaacatcacacactggggcctgttgtggggttgggggaggtgggagggactgcattaggagaaatacctaatgttaaatgatgaattaatgggtgcagcacaccaacatggcacatatatatatacgtgacaaacctgaacgttgtgcacatgtaccctaaaacttaaagtataattaaaaaaaagtaagatggtc

SEQ ID NO: 833 - DNA, 2175 bp, Homo sapiens
ggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccggcagaatttgtatagagatgtgatgttggagaactacaggaacctggtctccctgggttttgtgatctctaacccagacctggtcacctgtctggagcaaataaaagagccctgcaatttgaagatacatgagacagcagccaaacccccagctatatgttctcctttcagccaagacctttcaccagtgcaggggatagaagattcattccacaaacttatactgaaaagatacgagaaatgtggacatgagaatttacaattaagaaaaggctgtaaacgtgtgaatgagtgtaaggtgcagaaaggagttaataatggagtttaccagtgcttgtcaactacccagagcaaaatatttcaatgtaatacatgtgttaaagtttttagtaaattttcaaattcaaacaaacataagataagacatactggagagaaaccctttaaatgtacagaatgtggcagatcgttttacatgtcacacctaactcaacatacaggaattcatgctggagagaaaccctacaaatgtgaaaaatgtggcaaagcctttaataggtccacatcacttagtaaacataagagaattcatactggagagaaaccctacacatgtgaagaatgtggcaaagcctttagacggtccacagttctgaacgaacataagaaaattcatactggagagaaaccctacaaatgtgaagaatgtggcaaagcctttacaaggtccacaacactgaatgaacacaagaaaattcatactggagagaaaccctacaaatgtaaagaatgtggcaaagcctttagatggtccacaagcctgaatgaacataagaatattcatactggagagaaaccctacaaatgtaaagaatgtggcaaagcctttagacagtccaggagcctgaatgaacataaaaatattcatactggcgaaaaaccctacacatgtgaaaaatgtggcaaagcttttaaccaatcctcaagtcttattatacacaggagcattcattctgaacaaaaactttacaaatgtgaagaatgtggcaaagcctttacttggtcctcatcccttaataaacataagagaattcatactggagagaaaccctacacatgtgaagaatgtggcaaagctttttataggtcctcacaccttgctaaacataagagaattcatactggagagaaaccctacacgtgcgaagaatgtggcaaagcttttaaccaatcctcaactcttatattacacaagagaatccattctgggcaaaaaccttacaaatgtgaagaatgtggcaaagcctttacacggtccacaacactgaacgaacataagaaaattcatactggcgagaaaccctacaaatgtgaagaatgtggcaaagctttcatatggtccgcaagcctgaatgaacataagaatattcatactggagagaaaccctacaaatgtaaagaatgtggcaaagcttttaaccaatcctcaggccttattatacacaggagcattcattctgaacaaaaactttacaaatgtgaagaatgtggcaaagcctttactcggtccacagccctgaatgaacataagaaaattcattccggagagaaaccctacaaatgcaaagaatgtggcaaagcctataacttatcctcaacccttactaaacataagagaattcatactggagagaaacccttcacatgtgaagaatgtggcaaagccttcaattggtcctcatcccttactaaacataagataattcatactggagagaaatcctacaaatgtgaagaatgtggcaaagcttttaatcggccctcaacccttactgtacacaagcgaattcatactggcaaggaacatagttgaatgacatttctagtaatctctaattccagtgtctttacacagcaaataaattggagaatattgctcccat

SEQ ID NO: 834 - DNA, 2248 bp, Homo sapiens
aatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatagaaatgggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttgacttcaagactttggacttgaggctgggcacggtggctcactcctgtaatcccagcactttgggaggccgaggcgggtggatcagaaggtcaggagatcgagaccatcctggctaacatggtgaaaccccgtctctactaaaaatataaaaaaaaatttgctgggtgtcatggcgggcatctgtagtcctagctacttgggaggctgaggcaggagaatggcgtgaacccgggaggcggaggttgcagtgagccgagattgtgccactgcactccagcctgggcaactgagcaagactgtctcaaaaaaaaaaaaaaaaaaaaaaaagactttggacttgaaaccttccagaggaacactcacacaatttaagataggttctggagtcctctgaccctcattgaacaaagctggatttggctgatgataaaagaccccagccacaagcctctgggccagcctccagcctctctcggggcttgtttgctgacttgctgctgcacgtgggtatcagaagcaccaagtaaactatctccagggccagttcttttctctcccttccatttctaagtcaatagttgtctataattaaacatatttcagatttgttctgtgtccctgaagttccatattttatctttatgcttgtgttatgttttagtgtctataatgttgtggtgggaatcatttcatttggtttaaaagagtttgccttggaaaaactgaattaaccttcataaatacattttgagagatttcagtgtgagtaattttctggacataatattattgtataaaatatcaaaatggtgggccaggcgtggtagctcacgcctgtaattccagcactttgggaggctgaggcgggtgaatcacgaggtcaggaattcgagaccagcctggccaacatggtcaaaacccgtctctactaaaaatacaaaaaattagctgggcttagtggcgggcgcctgtaatcacagctacttgggaggctgaggcaggagaatcacttgaacccaggaggtggagattgcagtgagctgagattgcgccactgcactccagccctggcgacagagtgagactccgtctct

SEQ ID NO: 835 - DNA, 3205 bp, Homo sapiens
agctgctgccctgggcgcactgccttgcgggtcactgtggctgctcctgtgcttcagcgggactagaagctgccgcccacgggcagcggggaagaaatctgggcaaagccatgagccctccgaggctgagctccagtttaggggctcacctgccttgcatcgttccgagtcctgtactggactgcatcaggccgcgtctcctcaggaaatgggatcttggttcctggccagcacccggcctctctgcacctcatagacactgcaaatccttactcagtgacttcagggatacagtatccgtaacaagagaggaaattgaagtctggtcctatgaagctctcacggttacaagttttcaaactaaagattttctaagaaatattttcttacaaataaccccttctgttacataagggcttgacctgatttattaaaactatcctgactctctggcgaggaagggtgggaactgctgaaggtgcctcttccaaaggtttccagggtccttctctcggatggagcctgtccaactgcactctggggaagggagagaaacaggaaggcgtcgccttcacgctccggtcactcaggaaggtggctgtgcatgcctgagagcttgcgccggggtggaggtagccacggtcccgagacacgccctctgcccacacctccctaccagcctggccagacgcctggggtgcccaatcgtcttcatggtggcagctgcagaagtaatgacaactcatgggcatttggagaacgcaccaggcccacgctcaacattgcatttgattcctgcgagcgctcaacaagggaagcaccagacagatgctgaaatttaggcatggcagcactgctttgcctcccttggcagcacagggctgcggaaggactcagaattgcggggaaccctctgcctcaaggcgctccaccaggacacagacaccccctcagcggcccctctgctttttcttcagaatctgatacatctggcctggacgggagatggtgccctcgggcgccagagtgtggggtccccttcacagccactcccaccccaattcctgatcttccgagtttcctggctcacagtgttccttgttctcaaaccgctcgcttcactgcttccgattcaacttcattacctaaagtgagagatacagcttctttctttccctctcaggatcaatgactcggtttcaggtcaccatggagaggggattcagagctcacgcatccgccacacttgatttcaggagatgagtggctgcgagtcaccctgctgtgagccgccatggtcccctggtgaattgcccaggccaaacgccatggcctcacctgctcacgggcaaagcagctgccagcttaaatggtaagaaattagtaaaggaaggaaggaaggagggaagaagccggaagggagagcacgtctccgtccctcgatgacggcatcaggacgcaccacgtcggagacttcagctgccagatgagcacggcctattagggcctcgtccggtccccgcttatccaagggtggttaagaccaaattccttccccataattaaacagcatgtagacacatacaaaaataccgcagaagaactacaccactgggtcaaaacacatgccagaacaatatttcattttaaaagacaacataaatgtcaacatttaaaaagcctgccacataaggtgaaaaacaaaacctgttgtgtactgactagtctcagaactccttggcagttttatcttttccagaaaactctgtcttcaaaccccaagacctgtctccttgtggcatcctccacaggcttggtctacagcatgcatcctcaggggattcttccaggcttacctggccacgatccccagcacagaacagctcaagatcaccgtctacccccatctgccagagcaaatctattttccaccaagagcaggactgtcggctgtcagtcaccaaggacacccaggttgatagttggaggcgaccagcacattctgatgaagtaggtgatggtgcctgccccaggacctgtgtgcactgcaacaggcagcctgcagggcgtgtgccagaggccagggcctgagcaacagacacagcgctgcccagtgggccctgcacccttgcagtgaggggcagcctcaaccaacgaaaacaccacacactaagtcctagtttccatctaagaagtgttttctggaactttaagcaacattttatttccacagatgtggggaaaagggaaccctatggtgcataattattaacttactttagggtcctgtttctggactcagtggactcaagtgtagccaggtccaatctgtgcacttgcctctggaatgttctgccaacaccctttccccagttttgccggggaaggctgcaggcaaggagaggaggctattcctggccctgacccaggaggagagacgggaaaggaatgagcagacttgagcttaaattttcattggaagtatttaagaaacacctcatgttggtcctggttctctattatttctctctattaaaaataccaccccaagtaatctgtactcactatagaaaaactggaagtaaaagtaataattaaaaaaatccctgaagccataactcactcttctattactatagtcagcatttgctgtgcctcgtccaacaagctggggtcgcctcaggaaagaagactctaccgtgcccactgccctccctccaagtcctcctcctgtggcgtccctcgtcgggtagtgctgccttttgggaagtcactctgggtgggggtctccaccctcctgggaagtctccggaacagaaagcaggagacaccggcgcatccaggccccatccctccccgaattcacgggcagccagcagggggcgccacagcagcgcagcaacaggcacccggttgccggcatcaccggcccacgctcgttccctgtgcattttgtttaaaatttttgagagaaaatttacataacataaaattaaccattttaaagtgtacaactcagtagctttagcgtgttcacaatagagtggaaccattaccgctaattacagcacatttccatcaccctaaaagaaaaagtccgtttctcccaatgccttcctctcctcagccccacacccattaatctactttctgtctctgtggattttcctgccctggacacttcatataaatggaatcttacaac

SEQ ID NO: 836 - DNA, 1994 bp, Homo sapiens
cagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcgacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccaggtaagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 837 - DNA, 2406 bp, Homo sapiens
atcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagtcaggccctaaaaagagaggggaacaggagtccccaggtgagctctctgacggtcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaagtttggctcctgtgctgccggtggggggccctgtccctccccagatgtcctccctcttcttcacactcctcattgtcccttctacctcactaacctgtgttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaatccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatccc

SEQ ID NO: 838 - DNA, 2251 bp, Homo sapiens
gactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtctcaaaaaac

SEQ ID NO: 839 - DNA, 1959 bp, Homo sapiens
atgaatttaggaaatgtcgaggatctcaggtctctctgagaagaaaacagacccagggctacgagccaggtaaccagccgagggtggagggccaatttttctaagcctctgttggtcgtctttgaaatgggcgaggacgggcaggagcaatgatcaagagactccggaagacagagatgctccggcccaagaggcgcggagccacagagggttggggaggctccttccgtggacacggcgacagagagaacggaagacctcccgaggcctctgagagacccagatatggagtgaaactgaaggcaagctggggatgccgagaaaggccagagctgaggctggaaaggaggggcgtccagggagagagtttcccccggaaaagccgcccctcgccccaccttcgcgggggcagctgtcgggactctgcggggctggggagctgcctttctgtgacaaggcggcccgcggacagcctggtgtgtgggagttgtctcttatttttctaggactcaggtttgtccctgcctttcggcgacattcctttcctgtatccttctgtctgcctgtctgtctgcctctgaatctctgcgcctaaggcggtctcccctccgagcgtctctcttggtctctgtgggtaggtctcgcagcctctgtctcttccgctctctgcactgcttctcgaggcgcgtggctcggtctctcttcccctccctaccgctcagtcgttttctctggaaatctctttctcctcccccgcccctccgcccaagttgaagtctgaatcactgctgtcaagtcgctgagaagctgctgtgactccagcaagttcttcctggaggcagtctgcgatttctggagcagccggcgcaccttcgtgagaagcagtaaagcgccgggtcggcccaggcaggagagggaacttccgccggcagcttatctccgcgcctcccttttcacttctggaccgcgcgctgcacaatgcactaccttcccccaggcagtcctgaggacccaggagcagtggccccaggccgcagcaggccgggctgagctagagagagccagcctatagtgattcatccctgccgtcctagaacacgaggatgggaactggagtgtgcgagcggggcaatgcagagcatctccaggagggggaaagggtcaccgggaacccgcaggcagcccaccgctggaggcagcaggcagcgtctgttttctggaggggcagctggcacagctcagggcacccaggctggaccccagcacgctctcttttggctgctggctccctgtcttcagggctggaagagccacagccccggccacctggagtctctgccctcttccctcttgcgcttaccgcccagacctcagccggcccaggataggcagcagcaggcctacgccctgtatctttgggcctgactttcctcgcccttgagtgagatggaggggtgttcaccttaccggagggcctttctgggtagagaacagaggtccagaggagacggtgactgggaagcctcccacatgcagtaagtgctcaatcagtgctcgctgagtacgaagggaggaaggggagagtccattgagtttgcctttcagtggggaaagttggggaggtggagaaccaatgacccagggtccctgtgacctcggtgacacctggacaaggttcttcctcccttgcctctttcccccagccaccgcctcttgctcaccacagcccccaccccaacctgggtttgctatggagaatagggcagtccttccccaccccggggtggggtgtgggtgctgtgtgaccctttttggtccttgcacttttctgagccagggtcactgacacagctgagaccaagctgagggactggggaggggaggggaggggcgggatgttcatgctcactcctccgcaggccttcctttaggcccaggagaacaaaacaaaacaaacac

SEQ ID NO: 840 - DNA, 2203 bp, Homo sapiens
acatggctgcgtgaccgcgggatgctgtctgtccccttgctcagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgtctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacatcagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggctgagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggtggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccgggacgggctgtacccctggcttctagaagactgcctagcacacagtaggcattcaatacttgttgaataaataaactggctttcacct

SEQ ID NO: 841 - DNA, 2130 bp, Homo sapiens
acgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacctttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctggaggctgaaaaacaatcagctaatttacgggcagaacgtttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccag

SEQ ID NO: 842 - DNA, 2268 bp, Homo sapiens
agcggcatcctctctctagcttctggcgctgcccactgtaacccgactccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgccgccgctgctgctccttacagtcctggtcgtcgccgctgcccggccggggtgcgagtttgagcggaaccccgccggtgaatgccacaggccaccagctgcagacagcgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtgccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgacttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggacctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccgtctccgcatcccgggctcctggctcttgattttgtctgccacagacatcccacaaagccgctgccattttattaaagtgttttgatccactttc

SEQ ID NO: 843 - DNA, 2141 bp, Homo sapiens
ctcttggcttcaggctctgaagcactccccatctcaggcccaaacaggaataaaatcagttcctttctctgttcctcttactagactgagatccactgggattgcctgagggaattcttgtgaaaccagaaagaaagttcaagaaatgatgcaacaacaacaaaataaaacccaggagaaatagtacgacaagaagttaaaagatcgtgaggagagccctgcagtggaggaggagaacctgttggccaggaactgccaacagcttttgttctggataagcccctcgtggaggaggacaaggcaagaagatgggtcttcatcctaacccacggaagcagcgctggactgagaagcaccacctgcgaaactcccagccccactgagtaacctccagggcaggggcatgtccctgcttacgagctcccaccagcccgtcacacccccccacccacctcagaggctcctgcccctgacctgagtgagctgtgtctgagttgggtccctcctccctccaaggagtgtgctctatggacaacagcctctatcctcatttgtcccttcctcctagcgcctccttctgcacccctgaccccgctccatgctgtcacctcctctgtatggcagctgggcctcgtctgtcctgggacggtggcaagcatgtacagaagtcatcttccttatttctcactacccccagcttcccagatgggaaactgaggctcagagaaatgacataactcagctgacaaaggatctgagtgggtctgacccgcaagcccaccctcttcacctcatgctgtctaaaacaattacagacacctcccacgagcaggaaagctctggaaatgtcttcttggaaagcaagcagctacccatgaacagacttctcaaagcttttggccttggcctcccaaggtgctgggactacaggcgtgggtcactgcacctggccaaagcttttgtttgcttaaagtgctttgtaagtttataagaggaggctacagaacccagaaatcacctatggatttgaccacgagatgcgctgctgaattcatggtgggaaatgctgatgatctctgatggaggctgctgggtggctgctgcccacaccctgacctgtcctccccagctggacgggggacttctaggagggggagggtccccactgaagatggacacatgtcctgtcagagtttctgagaagctccagcccttaggcagaatgggacaaggagaaacagacttgggtctgtactcgggactgcagaagccgagcatgaggagttgtggggacagtgcccctccttcatccccacctcccagccccccagtatctccttctccccctgatccttcccttgatcaggccagggccctgtcattgtcccaacaaatgcctaccgccagttcatcgcaccttgttttctctgatgtcctcgcaatcacacaccttgtgcccctgagctgggtacacgatcctttgcaatgtgtgctacgagaactgtattgctaataataaagacaaaatttaatgactccactggctgagcttctggtaggtcccaggcacgttagacagactatttcattaattctcacctcggcaatttgaggaaggtcttgctgtctcagtatcctgagtcttagacaggttcaatgacttgcacaaggtcacatagcttttaagtgacagggcctggctgccttggctctgaagtgagttctctttgcaacaacctacccagctgagcccctcctttgtttagagaaggcttctcctctgagctgggaagatccaactttgaccctcaattctcagatgacagtggttcagtcaggcaggaactagctgtactaacttgtaaacaagtcacttctgcaaggagaggcagaggccagtgcttgcgcgagcgtgactgataaaggagtggggcgagggctgaggactgtctggctctaccgatttatgatactgaaagtcatcaatcttaaagagagatctgcattccccaagctttcttctccctgaggggcctctcctatctctcgccaatattgtggctcccctcagccgcaggggcaatctttctggttttctcttaggtccaaacacgaaccaaataaaatcctctttgcccttc

SEQ ID NO: 844 - DNA, 2774 bp, Homo sapiens
agtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcgagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttggtggctgtgtgtttggccttcagagtcaaagggagtctgcatgtatgggaatggttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatgg

SEQ ID NO: 845 - DNA, 1912 bp, Homo sapiens
agttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacaccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttcatgaagacaactattaatagaaaaatcagagtccagaactatggttctccatttctggtatactggtttgcagaagccttacattaaaatttcataaatgattgttctgctgttaagtgcaacaacatcacagtagagctacataaagattgaaaggagatattttatcaagtggcaccagaatggactgattaaaatagaatggcctaattggaaagaatttcaggatcaccggtttctcctgcttcatggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccacttcctgtgcttcccagaattccatcatctgactgccatcctagaaggcattctcatgaggaccaggaattccgatgccgatcgtctgaccgtcttcctagaaggcattctcatgaggaccaagaatttcgatgccgtagccacgtacgggattacagaaaatactcagaggatgggtcattcaaggagccactggaatcaaaaggaagatcccattccaaaattgagaaattttcagagtcctttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagaacatggagaagcacacatggctcccctgtttgaaaaagggcctgaataatactctgcttctgcctcatgacatcagatgctactgttttggtttttttctttgagccccaattcaccatttcaggatgtggatgggggcggggttgggggtaaaaacagctataaaaagcaactgcagatgctgactgactgcagtgggcagggtatgtagctgctccaagatgacttgcatcataccccaattactgctggcatcttagttgagagtataatctgcttggttgcctttttatgggaataaagagaataaaaggtattttaatagaataaagaaaaatttgaaaatataatggaaggtatttaaagagccacccacatagcttcaccaacccttctcacacatcaactcataaatcatcttaaataaaagtcattggtatg

SEQ ID NO: 846 - DNA, 1889 bp, Homo sapiens
agagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctaggctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctg

SEQ ID NO: 847 - DNA, 2001 bp, Homo sapiens
aaaaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaacttaactttccttaagtctggttccttgttggatctcaggatttcagatctgttcattctcattccaactactccttgcctgcaaggtacacagctctccacactccttttttttttttttttttgaggcagagtctcgctctatcgcccaggctggagtgcagtggcacgatctcggctcactgcaagctctgcctcccaggttcacgcctttctcctgcctcagcctcctgagtagctgggactacaggcgcccgccaccatgcccagctaattttttgtatttttagtagagacggggtttcaccgtgttagccaggatggtctcgatctcctgacctcgtgatccgcccacctcggcctcccaaagtgctgggattacaggcatgagccaccgcacccagccacggctatccatacttctaacccctcccccacctcctaccaaagccatgccaagcgtcagctgcatcagcctggtgccctattaataagactgtcaaaaagaggtctttgcccttcatgttgtctgcctgcttctccactaccactcaaagtcctttcccccttcaaatcacataaggactgcaggtaggcactagggggacctggccacatctggaaacagggctgtggctaagttccctgtgaaagtagaagagtcaaaaggcattggcagggttatggggaacaccaagggagggaacacccccacctcctcctagtaacctgaacctccctgcctgctgatccccagagtataaataatcccctggtgaactggcagtaacccttgggggttagcgccaagattctcaccccaaagcccaaggaaggaggcaggcaaaatggatagaagggcttttatttacaggaaaggaggacagatgaggatttaagtgtccagtgctcccagcgctagttggtaaagggaaatgcagtgttatctcttcttttgctggcgacctgtaaaggagcaatattaaacataagtgtttgttccagctcctgctttctgcaaaggcactcttctcctttccagtcccttagccaaactcataaattggtagtgtcttaggccaccttacaggcccatcccacattaacaaaacaaaacaagaaaccacaccacaaataaaattacgatacctctaaacaag

SEQ ID NO: 848 - DNA, 1774 bp, Homo sapiens
gggatttcgccactgcactccagcctgggtgacggagcgagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctctgccaggctttctccccgatgccgtccagctctgatcctgagtgtcatttcttcatcggcttccaggctgtccttgctagctggtttgactctcacgcatcaagcgtctcaaatttgagaatgcggaggagaaaagaagtgttgcgagaaggaggtgcggccttcagttgaggtctattaggaaaagattccaaataagacaagggcggggggcggcagtcgggagagcccccaggaagccctgtagatgcccccaccccagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccccaaggaaccaatggatgtcagtaggagtttctgttaaatgtctccttgatggggactcagtactgtgtagagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcgggagaatcgcttgaacccgggaggcgaagattgcagtgagccgagatcgcgccactgcactccagcctggcgacagagtgagactctgtctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtggtcccagctacttgggaggctgaggcaggggaatcagttgaatccgggaggcggaggttgcagtgggccggggtcccgccactgcactccagcctgggagacagagtgagactcagtt

SEQ ID NO: 849 - DNA, 2318 bp, Homo sapiens
gtgtgtgtgtgtgtgtgtgtgagagagagagatgtgttggggtggggggactgcaggtcaggaagtcctgcagatgtgcgtgcctgtgtgtgtttgcgcgcgcgcgcgcgtgtgtgtgtgtctgtgtgtgtgcctggagctgcgcttgcaggtctgagagtcctctgagaatgggttgggggaggcgggtgcaggaccgaggcctggaacagccaacaaagaggccctggaggagggtggggctggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacggcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctg

SEQ ID NO: 850 - DNA, 1965 bp, Homo sapiens
agttgctccggcggcgctcggggagggagccagcagcctagggcctaggcccgggccaccatggcgctgcctccaggcccagccgccctccggcacacactgctgctcctgccagcccttctgagctcagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcctgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccgcgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattc

SEQ ID NO: 851 - DNA, 2250 bp, Homo sapiens
agtcctggcccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaaggtctgcgctgggcactgtcctcgcaccgcctcacctagtcctcacgtagccctcgggcaagtgaggatccgccgggactgcggctgggagggatggctgtggctgtcccccagcccacacagtaggcgctcagtgtcagggtgcatattcccggggacgccctccaggcctgagagctgggggccgccgccgccccccatgcatccggacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 852 - DNA, 2448 bp, Homo sapiens
agttctgcctctgtccaggtccttgtgacccgcccgctctcctaagggagcgtgtcctggccccctcccgcagcggctcggaaaaaaggcagcaccgcgtcgttgacggcgcgggctctggactcgctgcttggtaaaaaccttcctcttcctccagtgcgggacgcactctctggtatctcttttgacctcccggaggctttcctttgtcggtcgcggcgccactgtactatggcatacctcgttttattacgcttcgcagatagggcattctgaaaacaaatggagggtttgtggcagccctgagtccagcaattgtatcagcgccatttttccaacagcatgtgctcacttggtgtctctgtgttacattttggtaattctcaaaatatttaaaactttttcatgatttctgtgtctgttatggtgatctatgatcagtgatctttgatgttgctattgtcattgttttggggtgccacatacagcgtcttttataagacgtggaacttaatgttgtgtgtgttctgaccgctccacccacagaccgttccccatctctctccctcttcttgggcctccctattccctgagacacaacaatattgagattaggcgaattaatgactctgcaatggcctctaagtgctcaagtgaaaggaagagtcgcacatctctcactttaaatcaaaaactagaaatgattaaactgagtgaggaaggtatgtcaaaagccgagataggccgaaggctaggcctcctgcggcaaacagttagccaagttgtaaatgcaaaggaaaagttcttgaaggaagttaaaagtgctactccaatgaacacacgaatgataagaaagcgaaacagccttattgctgatatggagaaagttttagtggtctggatagaagatcagaccagccgcaacattcccttaagccaaagcctaatccagaacaaagccctaactctcttcaactctatgaaagctgagagaggtgtggaagctgcagaagaaaagtttgaagctagcagaggttggttcatgaggtttaaggaaagaagccatttccataacataaaagcacaaggtgaagcagcaagtgctgatgtagaagctgcagcaagttatccagaagctttagctaagatcattgacgaaggtggctacactaaacaacagattttcaatgtagatgaaacagccttctattggaagaagatgccatctagaactttcatagctagagaggagaagtcagtgcctggcttcaaagcttcaaaggacaggctgactctcttgttaggggctaatgcagctggtgactttaagttgaagccaatgcttatttaccattctgaaaatcctagggcccttaagaattatactaaatctactctacccgtgctatataaatggaacagcaaagcccggatgacagcacatctgtttacagcatggtttactgaatattttaaacccactgttgagacctactgctcagaaaagaagattcctttcaaaatattactgctcattgacaatgcccctagtcatccaagagctctgatggagatatacgaggagattaatgttattttcatgcctgctaacacaacatccattctgcagcccatggatcaaggggtaatttcgaccttcaagtcttattatttgagaaatacatttcataaggctctagctgccatggatagtgatgtctctgatggatctgggcaaagcaaattgaaaaccttctggaaaggattcaccattttagatgccattaaaaacattcgtgattcatgggaggaggtcaaattgtcaacattaacaggagtttggaagaagttgattcccaccctcattgatgactatgaggggttcaagacttcagtggaggaagtaagtgcagatgtggtggaaatagcaaaagaactagaattagaagtagagcctgaagatgtaactgaattgctgcaatctcatgataaaactttaacagatgaggagttgtttcttatggatgcgcaaagaaagtggtttcttgagatggaatctacacctggtgaagatgctgtgaacattgttgaaatgacaacaaaggatttagaatattacataaacttagttgataaagcagcagcagggtttgagaggattgactccaattttgaaagaagctctactgtgggcaaaatgctatcaaacagcatcgcatgctacagagaaatctttcatgaaaggaagagtcaactcatgcgaaaagcttcaccgatgtcttattttaggaaattgccacagccaccccaaccttcagcagccaccaccctgaccagtcagcaaccatcaacctcgaggcaagaccctccaccagcaaaaagagtacgactcaccgaaggctcagattgataatcagcattttttagcaataaagtatttttaaattt

SEQ ID NO: 853 - DNA, 2165 bp, Homo sapiens
aaaaacaacaaaaaacagttgtaaggagtccatggcacagaaagtttaagcaccctgatttaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttc

SEQ ID NO: 854 - DNA, 1880 bp, Homo sapiens
cttatctatcatgtttccatgttaacttcaatgggttatttgaatcacatcagcagttagaaatgtcattataaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcgcacaggtactgggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatctggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatggtgagtcttgaaatgagaacatatgacaaccctgtggactggccacacaaaaacccgtaatcctagtttatttgatagttaatttccaaattgtatatagagtgattaaagaaaaaaattctct

SEQ ID NO: 855 - DNA, 2191 bp, Homo sapiens
ggtcccggccttgcggcctgcgggggaggctgcccggaggaggcagcggcggcggcagcgcgtcctcggtccccaggaccacggcttctttcctgccagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgttttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatatt

SEQ ID NO: 856 - DNA, 1926 bp, Homo sapiens
gcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccaggccctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaaggccagcctgggcaacacagcaagatcctgtctttgtaaaaaaactaaccaaacagggaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 857 - DNA, 2483 bp, Homo sapiens
aaagttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccggtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcgggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 858 - DNA, 2367 bp, Homo sapiens
tcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaac

SEQ ID NO: 859 - DNA, 2418 bp, Homo sapiens
ttataatttgcccatcagaaatagggtcttcttcccaggttggaccccggggagtttgggcttttcctacaatcactgaccctcactgtgactaaaggagcagaattaggtaacagtcctcccactaccaatcctcttcccgagggcatgtaaactaatgcagggtaaaggtgtggctagaggggggaccttgataaaagatcccatgtgactcaagagtaaggaaagatgagaagttagcagttgcgtaaagaaggactggggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaaggaagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatatggtggccagaatggatttgtggccaggggcatggatgctgctgctgctgctcttcctgctgctgctcttcctgctgcccaccctgtggttctgcagccccagtgccaagtacttcttcaagatggccttctacaatggctggatcctcttcctggctgtgctcgccatccctgtgtgtgccgtgcgaggacgcaacgtcgagaacatgaagtgagggtctgggtgtttcctgagggaacgagaaaccacaatggctccatgctgcccttcaaacgtggcgccttccatcttgcagtgcaggcccaggttcccattgtccccatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcctgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagc

SEQ ID NO: 860 - DNA, 2182 bp, Homo sapiens
agaaccggaaaacaaggagtaacagtcgcgtttcaaatctcgcagacctgctggccgatttcgagtcttctgaaagaggaaggcgagcaaagccaaaattctcccagagcgcgaacccaaacacagatcaccgctggggtccaagcgcccttcaactccgcccgctagtgcccaagattaccgggaaggaattcaacgaatcagtggtgaggtgccgccgccatgcctactacgggcggaaatttgagagaaagcttcgcaccggtaggaaaactgaggagcaaccgagcacgattggaaaggttgacgatagtggttaagtggctcggccttgccctcagttaaaatggcaattttagttgcttcactgatacggaatcggcgaggcgccaaggaggcttcctgcgtggggccgcagagcgagtcgggaaacgattttaaactgaagaggcggcggagggccgaattcccttttctcaacggcttgatttcagagctgggctggtctctgacaggctcagctggagagggacgggttgggacgcactgtccttttgcccttccccctccgcgagcagaagctgactccgcaggagcgagggtcgcagagctgggtgagcggaaatgtccctcccagagtgaagtcgcagggcccgccccgcgtctgagggagcggaggtcttcctgggtgcgtttgtgtctcttgtgaacccacttgtggagcgagagggaatttgggagggccaggggttagtctggcctctgtcttagctgtcattttggcggtttttttttttttttcttcaggggatttcagtctccacatagttttggagccggacttttgaagaatgattcgtgagtccggaatgggtgacagcgtcatcacggcattttattggtaaagatgctttgtattggtcccggacctgctttaactttgtatttgccctgttgtgtggtcattatcttacaatacttgcgtgttgaggtgtgtttaaacactacgtgcttaacactggctaagtattggcattggggcggttggatttagctattggtggcaatgtagaaaagtgatcaagtcagagccccttcacggactaatcacaagagaaacaacaaagctttacttgtgtgctgtgaaccacaactgcaagtggaattgtcaagagaactagccctgccaagctcaggaaaacttctgaggagatggcacatggaaaatggataagatttactgagacaaacgggagtagagaagtgtttttaattggcgataaggtgaataaaaaggcagggagaacagtagagtgatcatctgtctagagtagggggtgcatgtttgggtatagggctgtcatttaacctcttaaagaattgtctactggaactttcttcactcccatccccccaccccccaatgttgtatacaaaaccttagaggaagtgtatgcagaatgttggattttggaaaggctaatgtcgatggatcttggggaagaactgaagtagtagaaaatgaacctggataggatcagataataagatcaaatacagtagtgccttgaaagccagacaggaattctgatttgacttcatatagatgtgtgggaactgttatgggatctcaagcaaggtaatgataaaagtggtgacaatgaaagactgatgatggattagggaagggggctaagattgggaacaagataagtagctataattgagaatgaaagtgaagcccacatctaagaggacaagtgtatatctttttaagaaatatgtcagaggccaggtgtggtggcttatgcctgtaatccagcactttgggaggccaaggcaggcggatcacctgaggtcaggagttcaagaccagcctggccaacatggagaaaccccatctctaccaaaaaatacaaaaattagccaggcgtgttggtgcatacctgtagtcccagctactggggaggctgaggcaggagaatcacttgaacctgggaggtggaggttgcagtgagccaagattgcaccactgcactccagcctgggagacagagtgagactctgtcttcaaaaaagaaatatgtgagaatttgatgataaagttaacaaagttaactttttagatgtaaaggtgatgttgaaggaagagtaaaagatgatgaaagtttttttagtgggg

SEQ ID NO: 861 - DNA, 2020 bp, Homo sapiens
agctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtcttggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctgctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtgcagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggag

SEQ ID NO: 862 - DNA, 2333 bp, Homo sapiens
ggagggaggacagcgcgaggtccccggacaaagcgtggcgcataagtccggcccgtaacttggtgggcaggcaacttaggggatgtgggcctggttatagctgagcatgcttttctattcctcccagaccacagttcttcagacctggagccactttcagagaagagtgtaagttgcactgaattgaaaaagggaaaagtttaggactgcagaagatggaattcctggggacgttaaactgggctaagatggagcagataagatttccttaattagagcaagacacacctagtatctagagcctggaagtcttggtcaaggattctccctaacatctcagtttctcagcactaacattcctgctactaaaatgaagtgagaaattaatttctgaagttaagtaaagaaataaactaaaattcctagaaaagaggtaagaagaatgagcctttgaaaaatgtcttcacaaagactggcatgatggcatggaagaaagagccccagatatccagtatacatctcaaggtcaacttgtccaaaacagagctactgatgattttccccttgaaatctactcttcctacagcttattcatctcaaatagctggagtacagtggcatgatcatatctcactgcaacttctacctcctgggctcaagcaatcctcttacctcagcctcctgagtagctgggactatagtctccctctcttgccaagcctggactgtactgccatgatctcagctcgctgcaacctccctgcctcgagttctggtgattctcctgcctcggcctgacattccaggcaggcgccgccactcctgactggtttttgtatttttggtggagacggggtttcaccgtgttgaccgggctggtctccagctcctggcctcgggtgatctgcccacctcggcctcccgaggtgctgggattgcagacggagtctcgctcactcaatgctcaatgttgcccaggctggagtgcagtggcgtgatctcagcttgctacaacctccacctcccagccgcctgccttggcctcccaaagtgctaagattacagcctctgcccacccgccaccccgtctaggaagtgagcagcgtctctgcctggccgcccatcgtctgggatgtgaggagcacctttgcccggccgccccgtctgggaagtgaggagcgcctctgcccggccaccccgtctgggaggtggggagcatctctgcccggccaccccgtctgggaggtgaggagcgcctctgcccggctgcccagtctgggaagtgaggagcgcccctgcccacccgcccattgtctgggaagtgaggagcacctctgcccagtcgccccgtctgggaagtgaggagcgcctctgcccggccgccccgtctgggatgtgaggagcgcctctgcccggccgccccgtctgggatgtgaggagcgcctctgcccagccgccaccccatctgggaagtggggagcgcctctgcccggccgccccatctgggatgtgaggagcgcctctgcctggcctccccgtctgggaggtggggagcgcctctgcccagccgccccgtctgggaggtgaggagcatctctacctggctgctcatcatctgggatgtgaggagcacctctgcccggccgccccatctgggaagtgaggagcgcctctgcccagccacccttcgtctgggaggtgaggagcgtctctgcctggccgcccattgtctgggatgtgaggagcgcctctgcccggccgccccctctgggaagtgaggagtgcctctgcctggccgccccatctgggaggtgtacccaacagctccgaagagacagcgaccattgagaacgggccatgatgacgatggtggttttgttgaaaaataaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctgtgtcaactcagggttaaatggattaagggtggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacgtgtttatctgctgaccttctctccactattatcctatgaccctgccacatccccctcgccgagaaacacccaagaatgatcaataaatact

SEQ ID NO: 863 - DNA, 2337 bp, Homo sapiens
ccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagacaagaatttgggacccgccgaatggcgaggctaaaagagctgtaacacagacaagactgagacctgctccttgcttgccacattgcgagtgaagagaaggagagaagagctgcagcctttcagggatcccagacctgggagctccccaagccagggctgtgactccttctttggggtgctgcagttcctggtgtctccgagcttctggatgccactgtgttccctggtgtcagctgtggaagctacttgcggtgtgcctgtcccagctgcagcctggcagagagctggcacctgtgctggcacctggagctgcccacccttctgcagcagccggcatatctgactgtgcattggccagaccccacactcactctcacaccccttgccgctccatgcagtctcccttggcaggtgtggaatccaggccattagtgtgagctgaacacagcctgccaggtcgagtgagcagaatgagctcagtgggctgaagcaaaaatttgggcaaaggcacgactggccacagaggtttccagccagaaaagcaacaccccaaagatcccataataataggagtgcaaaacctgttgtaaactgtgcatgccagggatctaggttgtgtgttccttatgagaatctagctaatgcctggtgatctgaggtggaacagttttatcccaaaaccatccccagccccatccctgtccatggaaaaactgtcttccacaaaacctgttcctggtgccaaaaaggttgggcactgctattctataccgctgtaggatgactatagttaacaataatatatagtttcaaaaagctagaaggaagacattgaatgttcccaacacaaagaaatgatacatgtttgagatgatggatatgctgattatcttgatctgatcactatacatgatatgtattgtaacatcactaggtaccccatgaatatgtacaattatgtgtcaagataaataagtaataaaataaaaagctttatcttattccccaaaaaaagactgcttgaggaaaggaaaaaggaagattactagcagagttgtaggctattgtctatggtactttactgcatgaagaaggtacagaggctgaatggaagaggggttgtaaaattggagtatgggctttcctttcacatggagctttgtttaacagaagtctagaaagtagatataagaatcattatcatggttagtttatgtcaaaactatacatactgtcttattatacttaattaaatgggtaatcatttgactagtgtgtctatgagttcgtaagttggtacttaatggttatattatttaattcacctcagtggacagagattaaaacagagtcattttctggttccttttcctgtggttaattaagtcctttgagatatggctgtatacactttatggtggtttacacatgtctgttttattagttttgcagacagtagacaggaacaaaaaggggcatagtcattcttgctgtgagttaaccctacacttctccaagcagtagaatgtaaactcaactaggcttttgagaactttccctcagtgacttaattaattccatgcccatttctggactttggaatatagcatgcatctatgtagcttgttttttactttatcaaatttaaaatgctcattatcgaacatttatatttttatattaaacttttgtaagtataacctgcttggtttcaaatatttcacatgcaacatgacattggttggaatagtgttatgttgtatgtaaaagtgtaagttgtatgtaaaagattaatatcacaatcctttgaaatactttgcaccttgctattgaataaagttgatgacttttaattctgttgacataatctagaacccatagggaaactctatgataatgttttacttctagaaagtcagtcaataagt

SEQ ID NO: 864 - DNA, 1999 bp, Homo sapiens
gtcacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaac

SEQ ID NO: 865 - DNA, 2234 bp, Homo sapiens
gtgctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagtaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcgacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgggacaagacagccagtagaggtgacttcatgttttctgcggatcgtttgatcagacttgttgtggaagagggattgaatcagctgccatataaagaatgcatggtgaccactccaacagggtacaagtatgaaggagtgaaatttgagaagggaaattgtggggtcagcataatgagaagcggtgaggcaatggaacaaggtttacgagactgctgtcgatccatacgaattggaaagatcctgattcagagtgatgaggagacacaaagagccaaagtatattatgccaaattccccccagacatttaccggagaaaagtccttctgatgtatccaattctcagcactggaaatactgtaattgaagctgtaaaggttcttatagaacatggagttcaacccagtgttatcatcctactcagtctgttctccactcctcatggtgagttcagcatgaggcagtaactagggctccatatagtcctgaggtgggtgccaaatcaatcattcaggagtttccagagatcacaattttaactactgaagttcatcctgttgcacctacacattttggacagaaatactttggaacagactaagttatttaagtaaaataattgtcttatgtaatattacaatcatgttttgattttctatttgttttactgattcacttgagggtggcagagaaaaatgtgttaaaatgctttttagttttggaagtgggtatatttgaggttatatctcatttagttatttgtttactgttggcaccgaattcaacaatgaagtatatgcaactcttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggtgttagctctactaaggtttcacatatgtggctattgccacattcctctactgttttctttctgatactggacatgctagtaacttggagaggagaataaaagaatgtctcctggaattttacattcccattaatgtcctcattcaattggtagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaacatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtg

SEQ ID NO: 866 - DNA, 2319 bp, Homo sapiens
acctcgggggtttcctgctttatggcgaagggccagggccccacaccttccgcctgacagccagccaagctcttcagtcccccgccctccacctgccagggaggctccgggcgttgtacctgccaccacgggacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacgcctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagactaaatgttggttataaactcacctgacatccacagggcccttccaaaatactgtcaaggctgactgctggtgcctggaacctgtacaccctcctgggactctgcatctctgctggggctggtttctcctctgagccaccttaaggaatcccaccctgacccggtcagagctcaccatgcctccctctcctacttgctcagcattttgtgtctatctagactaaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaacggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggagtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcatctctgcccaccctgtggggtaaaactgtttgaaagtgtttatgaaagttttatataaatattggctgatcaaatgtacaaaatatgcatgatggcaccatattgtgtataatagtgacaaatacagtctatgtgggtggag

SEQ ID NO: 867 - DNA, 2082 bp, Homo sapiens
gaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggatgaagcagatgagaaggatgattcaggtgctaccacaatgaacattggttctgacaaacttctgttccgaaacaccaatgtggaagatgtctttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaat

SEQ ID NO: 868 - DNA, 2172 bp, Homo sapiens
aaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacattcataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactacctttttttttctggttttgccattcttttattcatgttgttacactcagtataggatagtttattaaaatcattatgtctgtagacattctatttgtgatatagaaattgtgttatttctgacctctattttttcctattatgtgacaaagaacataggtcctcagaccaacatgtggaaaccaagggccaaatggcttctaaggtccctcccaactgaataattctggtaaattccatttccatgtgctcactgacggatggtcctaataaccgctcttatttcttttatgcttgtgaaagtcatagtttttacaaaattacttgagggtgtattataaagattcaacagagcaaagtaaaggccaagtgacttgacatagtcatagctggaagaggagccttaccaagacaggtgtttctagttgccattatacttattctaccttatgaggacccattgtatgaggctagatggaagtgagtaaacagacgtcctacctttg

SEQ ID NO: 869 - DNA, 2150 bp, Homo sapiens
agagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgcgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctt

SEQ ID NO: 870 - DNA, 2082 bp, Homo sapiens
gacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacatgccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgtgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatg

SEQ ID NO: 871 - DNA, 2226 bp, Homo sapiens
actaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagttcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagtgctggagacactgatgctggatgacaacagactctccaaccccagttgctttgccagcctggctgggctcaggagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccaaagcagcctctggtgctccatcacccgcgcatgaggacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggtgctgtcctgcaccagtggacagaacggcggctggtgaaccacaagcagtacctggaggccaagaggctgttgaaggagttccaggcacgttaccggcagctgagtctcaatatgttgcccaggctggtctcaaactcctgagctcaaatgatcctcctgcctcccaaagtgctgttatcacaggagtcaaccactatgcccggcttcctaataatttttactgctgctctcaaagtttttgacaacgcacttgtgttgctggcaaacaacattttcaccgcaatgctgagccactgctaacagaccattagctaaaaatttacaaaagtgaaaaaaatcatgtatccatttaaatattcaaatgaatcatgttggtgttttctcaatatggagttctgtacaagtttttgtttctttgttttcattgcttttggttgttatttataaggatttgagaacttggtctctagaagagagtttttatactgaaaaagactaagggagggtgagaaagtagcattttaaatgtgaataaaaaatatcaattgct

SEQ ID NO: 872 - DNA, 2376 bp, Homo sapiens
gagtccaggacctgccagcgctggggattcttcccgaacaggcgcttgccctctcttttatggagcttgggcccctgccgcagcccggtagaggctgtggaggtctaccgtccggaagcctggttcccagccccgtggcccattcctggctacggggagtggaggctcccacgaggtagcggtggcctgcagcggcctcctccccgcagtgaagcatgggccagaagctctcggggagcctcaagtcagtggaggtgcgagagccggcgctgcggccggccaagcgggagctgcggggtgcagagcccgggcggccggcgcggctggaccagctgttggacatgccagcggcggggctggctgtgcagctgcggcacgcgtggaaccccgaggaccgctcgctcaacgtcttcgtcaaggacgacgaccggctcaccttccaccggcaccccgtggcccagagcaccgacggcatccgcggcaaggtgggccacgcccgcggcctgcacgcctggcagatcaactggccggctcggcagcgcggcacccacgctgtagttggtgtggccacggcccgtgctcccctgcactccgtgggctacacggcgctggtaggcagtgacgccgagtcgtggggctgggacctgggccgcagccgcctctaccacgacggcaagaaccagcccggcgtggcctacccggcctttctggggcccgacgaggcctttgcgctgcccgactcgctgctcgtggtgctggacatggatgagggcacactcagcttcatcgtggatggccagtacctgggcgtggccttccgaggtctcaagggcaagaagctgtacccggtggtgagtgccgtgtggggccactgtgaagtcaccatgcgctacatcaacggccttgaccccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctactgccctcgaggcagccctcccaagtcagacacctccttcggagccacagagagcctggagtctgcacctcctggaaatcctgccaccaaccaggacacagcagccaccgtattgatcagagagcctgtttccttattcaagagaatgaataaaacatttaggcaggagactttctattgtgtgccccgttgcagacagggccagggagaaattagccagtgcagggggaaaattgcctctgaataatgaatgatgaaagcctgacgccgtgcccctcctggcccatacgccttgccagggcggcaggattgtcacaccgttttaggactctgtgccactttgagagactgttcccaggaggcccaaccgcagacctggcaagtggacagtgcagtgtggagacaccttccggcttacctctttgaaagttgtttacctacccctttccacgtgctccccttcccagccactgactcacagttctctggatgcccagacacctctcttcagggaagatgagtctgactggtttgccccagggaagagtgtatccttaccattattttaagtagcatttgcattttaaaagaggaatgcggagaggacagtacttagtccaaaggtgctaacgggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcagagccccagacagcactgcctcttcctccccaccccactgcccccaccttaatgtgaatttgactgatgaatgaagagcgtttctaataaagtttgtcattcagtcct

SEQ ID NO: 873 - DNA, 2918 bp, Homo sapiens
gggtgtgtctgcggaacctccacctgagctgtagagtgtttccctcgacccactagtctgggttccacagggtctgagctcctcagaggtgggagctgcggccgagggaagggtgcatgtgcgcggcgacaatcaggcctcttccccaggcagcttgtgagcccctctccctctccgccctcgcccaggctgctccgatcttcgtttccttgcctaggctcatacacccaggctttatttagggccaaagtatccgtcataacctcggttttctgtctcgcaagtatcttgccgctcaatttgtgaccctgaagctttagtgagtcgctctgtgctcactatttctggtcttttcagaggatggcttcactttcaatggaattgcccgagtaactgccctgtgttgtcacgtaaacaagtccttttaaactgagtctgtagttgtcctgtgttgagtgttttcttatatcaaaaactttcctgaccaagaacaaaaaaggagctcaagtaaaatcacccatttgactagaccccaactggagagaacctttgcctgagctgtctaagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttacggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaaaaggaaacatgatgagattcaaagaagtttgcctgttaaaccttccaaaatgctaaagccatcagggacaccattttcaccagacaaagtaggagattggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattc

SEQ ID NO: 874 - DNA, 2792 bp, Homo sapiens
aatttagagaagatgtagggagtgttcaacatgttcgttgtggaagagaaagagctaagagagaggagcttaaagacacaaacgggtagaatcaaggagtgtgctctcaaatgagaggaacaggagtgacattaaccttgaaatgctcggagactctactccttcatgacagtaggaggataattaacaatagatacaaatgcaggaattgatgagtgccatcagaaagctgtatcatgagctgcctgcacttctaaagtgtccagtggatttttaatcacatgagcctggaaatagggttatgaaaagaagctcagagcagagcaccgaaagtggccactaccagcatgaagagcccaacaattcaaactggtgaagtgagaaaaacagaatgcagctttcaaggttcgtttcaagcagttggcttgtgggactctgagagatgctgctgcccatgacatgcgggaattatcatgatcaactacccagcttggatttcatccagtggccaagagctttgtgtgggagacggcaagggttggatttttcaaaagagtaaaccaggataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggagaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaac

SEQ ID NO: 875 - DNA, 1782 bp, Homo sapiens
gatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgttctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacaggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgactgaaatccaatttggaatttggtagcagttaattcaagccaattttttttgtttcttcatttcccctcccccaatccatgaaagcctaaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacat

SEQ ID NO: 876 - DNA, 3394 bp, Homo sapiens
agtccagccggcccggccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccgaagtgggaatgatggctccatttcacagatgaggaaaccgagactcagagcacaaggccacacagcaggaagagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaagctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacatacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccacccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccactactgcctcccacaggcaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatc

SEQ ID NO: 877 - DNA, 2930 bp, Homo sapiens
ctgtcgctccggttcctctgcctcctctggctgctgcctccgcagctccctcctcctaccccacctcctccatctggggagcgtctgcgggggcctgaggggcggcggcggcggcggcggctgcgatatggagccaggggccggcggccgaaatactgctcgtgcgcagagggccgggtccccgaacactccgccgccccgggagcaggagcggaaactggagcaggagaagctctccggtgtggtgaagagcgtccaccggcggctccgcaagaagtaccgagaagtgggagattttgataagatctggcgagaacactgtgaggatgaagaaactctttgtgaatatgccgttgcaatgaaaaatttggcagataatcattgggcaaaaacttgtgagggcgaaggtcgtattgaatggtgttgtagtgtatgcagagaatatttccaaaatggtgggaagagaaaagcacttgagaaagatgaaaaaagagctgtacttgccactaagaccactccagccttaaatatgcatgagtcttctcaacttgaaggtcatttaaccaacctcagctttacaaaccctgaatttataactgagttgctacaagcctcaggaaaaatcagattacttgatgttggcagctgctttaacccatttctgaagtttgaagaatttctaactgttggcatagatattgtacctgctgtagagagtgtctataaatgtgatttcctgaacttacagcttcagcaaccactccagcttgcacaggatgctacagatgcttttttgaagcagctgaaaaaccctattgattctcttcctggagagcttttccatgtggttgttttctctctccttctttcttattttccatctccttaccagcgatggattgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaatgtgatacagaaaaatagatcggttagttgttttgtgatgcacttatctttttcttttttctaactaaaattgtgatgttacagaaagtcattttatgttcctttttttgtctgatgatccaatatttactgaactttttgtaattggtgataattctttttatttcttccttatattaaaagctcatttgacagcatcagacattgggggagagatgtcccccaaagtgtgtattctaattttattagccctatccaataaacaccattgccaaagtagtattttcataactttcttgtatgatttgggccttggtgtgaagtatatttacctgagagttcacttttacttttcttaaacttaggcttcatttacaaaatgttttatttaagcaaggaacaatgtaatactcaataatgacctaaaacacctttttgaaagggtttgcacttggaagagagtttatgttctgttgaaaccaactttgatagggtcctcacctttccgttaaggaggtgccgcactacaagtttcaaattatatggaaaaacctaaaattaaccctctgttggtgatctcataaaatggttttgaccttttggtatcttaatttctatctaaactttatcagaaaattttctttgaatatatcaattagttggctgtgggaattttccctttccacattaataaatgcctttctgtgtttctgaatcagaagcaaatgattagggaaaaatatatgtccaaacaagacaagattagtttaaacagttaagaacatttagtccacattgtcttgtcagccagcaattgtcatggaagctatcatttttaagagtgccactgtgtggatttttttttcaagtggttattacattaaaattacctcatactgaggtttttgcactgaaatatcacagtttcagatttcatggttaatgttgtgcgtatgtttgtatgtttttaaaggaaacttgcattttcaatagttgatcctaaatttcataaactgcacttctttactctggtaaagctgatgtttttgtgcttattgtgaattgccgtagtacctttgaatgtcaaactttatttagaaatataaaacttatcctttatgatataaatggttgagtgtatgtacccagtatttctaattaaatttcacatgctaaatt

SEQ ID NO: 878 - DNA, 2734 bp, Homo sapiens
tttatttggtggcaccaatatctcttatgatgttaaaccctatagggtttattttctgtgaaatccaaaagtggaaagacactcaaaatgcttctcaaaataaaataaaaattgtgggactcggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcatggtctcacgatggtgggaaaaataaagagactgaagaagtcggcatttgtagtactaattcttctcatcacagctaaacttctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttgatctggtctctggctattcttcttttgagtaagaaatataaacagcttcctcatatgcttacaactaatttactcattgctcagtctattgtctgtgctggaatgatgatatggaattttgttaaagaaaaaaattttgttggacaaattttggtgtttgttctattgtacagctccctctatagcacctacctgtggacaggccttctagcaatttctttgtttcttttgaaaaagcgagagagggtacaaattcctgttggaataatcataatatctggctggggaattcctgctctccttgttggtgttcttttgataactggaaaacacaatggagatagcattgactcagccttcttttatggaaaagaacagatgatcaccacagcagtcaccctgttctgcagcatcctgatagctggcatatccctcatgtgcatgaaccagactgcccaagcaggaagctatgaaggtttcgatcagtctcagagccacaaagtggtggagcctggaaatactgcttttgaggagagtccagcaccagtaaatgaaccagaactttttacaagctctattccagaaacaagttgctgctcctgctccatgggaaatggtgaattacactgcccatcaatagagccaatagcaaacacaagcaccagtgagcctgtgattccttcgtttgagaaaaacaatcattgtgtgagtcgctgtaactcccagagctgcatattagcccaggaagaagaacagtatctacagagtggagaccagcaactgacccgacatgtgttgctgtgtttacttctcatcattggcctgttcgctaatctttccagttgtttatggtggctattcaaccaagagcctggaagactttatgttgagttacagtttttctgtgccgtgtttaactttggtcagggatttatttcctttggaatctttggattagataaacatttaatcatcctgcctttcaaaagaagacttgaattcctatggaacaataaagacacagcagaaaacagggattctcctgtttcagaggaaataaaaatgacctgtcaacaatttatccattatcaccgtgacctctgtatccgaaacattgtcaaagaaagaaggtgtggtgcaaagacttctgctggaactttctgtggctgtgacctggtgagctggctaattgaagtcggccttgcctccgaccgtggtgaagctgtgatatacggagacaggctggtacaagggggagtcatccaacatattaccaatgagtatgaattccgggatgagtacttgttttacagatttcttcaaaagagtcctgaacagagtcctcctgctattaatgcaaacactctccaacaggaaagatataaagaaattgagcattcatccccaccctcacattcccctaagacctaaattatgcaggggagaaccctacatggaatcatattctagccgcgtattcattagtttttagctgggtgaccttgggcaagttaacagaggcaacctctctgagcctcagttgtctcttctgtaaaatgtgaaaagatgtgctcccaccacatgcgcagggtctgtgattttacatgtatgtaaaacacataggaagctgacttaggaaaaagagaaaaccaaattaaagttctgataatgaatataatatagtcatcctttagtatccaaggggattggttccaggactcctgaagatcccaaaatctgaggatactcaagtcccttatataaaatggtgtaggccgggcatggtggctcacgcctgtaatcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctc

SEQ ID NO: 879 - DNA, 3182 bp, Homo sapiens
gatgatgtatttccgcttctggtctgcctggtcgtttttggttggatcggcttgttgcggggagggagggggggagattgtttgcagcatagaagctccgcggacgggaaggtaaactgagctccccagagacgctcatcctacagcctcagctcgggcccagccttctctctccagctgccaccacagcctggaggcgcctgcctccaccctcccgaatggtgctcctcctagcaggcctcggtccaggatccaagccccctttgccccctgccttggagctgttgctccgggtttgtcacagtggactccctgtggcgggaagggaagaacttttgcacagacaaggcttcagctctaggaaccccactgacaacttgaatctcaacctctaacctagtgtgaggttcttcctgtgcccaccttttctgccttttgagaagagaaactcttctcctggccatctagagcccaggaagccccaagctggggccctggtcccagcatgtcagtcctctcttgtgcatagggctctgccctccccctgtcagcatggctgagctcagacaggttccaggagggcgggagaccccacagggggagctgcggcctgaagttgtagaggatgaagtccctaggagcccagtcgcagaagagcctggaggaggtggaagcagcagcagtgaggccaaattgtccccaagagaggaggaagaactggatcctagaatacaggaggagttggagcacctgaaccaggccagcgaggagatcaaccaggtggaactacagctggatgaggccaggaccacctatcggaggatcctacaggagtcggcgaggaaactgaatacacagggttcccacttggggagctgcatcgagaaagcccggccctactatgaggctcggcggctggctaaggaggctcagcaggagacacagaaggcagcgctgcggtacgagcgggccgtaagcatgcacaacgctgctcgagaaatggtgtttgtggctgagcagggcgtcatggctgacaagaaccgactggaccccacgtggcaggagatgctgaaccatgctacctgcaaggtgaatgaggcggaggaagagcggcttcgaggtgagcgggagcaccagcgagtgactcggctgtgccaacaggctgaggctcgggtccaagccctgcagaagaccctccggagggccatcggcaagagccgcccctactttgagctcaaggcccagttcagccagatcctggaggagcacaaggccaaggtgacagaactggagcagcaggtagctcaggccaagacgcgctactccgtggcccttcgtaacctggagcagatcagcgagcagattcacgcacggcgccgcgggggtctgcctccccaccccctgggccctcggcgctcctcccccgtgggggccgaggcaggacccgaggacatggaggacggagacagcgggattgagggggccgagggtgcggggctggaggagggcagcagcctggggcccggccccgcccccgacaccgataccctgagtctgctgagcctgcgcacggtggcttcagacctgcagaagtgcgactccgtggagcacttgcgaggcctctcggaccacgtcagtctggacggccaagagctgggaacgcggagtggagggcgccggggcagcgacggcggagcccgtgggggtcggcaccagcgcagcgtcagcctgtagccgaggggccagggttcctggcttgaatctgccaccacgggccggttggggcccacagtcttctcacgccctctcctctggggcctcgtcttcccgaaggtccccttctccagtgcttccctgggagaggccagctgtgttcgagtcctctgtgcctgccctggcgttctcacagcctcccccttcccctcagcaggcggctctctttgccttacccattcagaaggctcgccctcggcgctctgtctgcctctgcctgccagctcatcacgatctgcagggcattgaccctttgctttccctttctgctccctctctttccatctgtttggctttttccctcagggaacttggtctagaaggcactgggaagctcatcagagaaaatgggtgctgggcctgagtactcccgtcggaggggatggacagtcacccctcccgttggtttccagccccgccccccttcccaaggcaactctggagggtaccctaggtatgctgctgagccctgccccccgtcctgctccagcctgcccgtgtgtaacctgtaagatgtactgtgtgcctccggaagacaccacctttcccttcagcattccctttcatgacctgaggcactctgcgatgtgtgccccaaagcagaacttacagggcctgcaggaagctggtgtcagggagagaaacccaaccccactgtcaacatagggagcatcaccaactccagactggctcctgtgggtatggtgtttccgctgggctgggtcctcaacattgccaaggtgctagtgggtccctaagagggcccatgttgggggtgaagtcatgaggtcctgaaggcttaggcccctgtcattcccaccctcactcttgctgcacagttgtgtttactttttctgggtagaggatgctgaactgactcagcaccctcctgcaggacggggttagggaatttggtgctcaattgctctcccttgctcttccccaaactgaaaatacctactgcaggatccctcggggcacactgaagcttggctgccaaccctcttacttcctttgttacagggaggggttggcttggggtgaaaagttctgccctccgcagggagcagctccagctgcctggcagtgctcccagtttgtagggaagccacaccagatctgggtgccttgggagaaccagtccttccttttgacccaccccaggaagatggagtgctcttttctaggcccatgttctgccagcaaccgggatgcgtgggcaactggactctgcacgggggtctacaggttgagggaggttggtcacaatgagaacctcggggtttgaggtggccatgggcagacagccgaaagggagggagggtgtgggtgtgcgtgtgtgcatgtgctggtgtgtaagggggaaagggtctttcctggttttatttaaataaagtagtttatgtaac

SEQ ID NO: 880 - DNA, 3127 bp, Homo sapiens
gtatttattttccctgtgtttgtctctagtgtcctcctaaacagcctttcctgtgagtctttctcagaattgatatcttaatattgtctgttctaggtgttgcccaaattcagtgtcagtgaagttcttttcctgggcaatcttaacatctttactcttattgtctggaccttcaaagggctttgtattttacacctgcgcccccaggctgctcacagccggcttgctgcctgtcctgcctgtccggatcttgtctcctagtcctgaggagcggaggctgagaactcagtgctggtttgtaaatggtgaggggacttgggggcatcccagagtgctccctccaggcctgcttcttggttttgtttcatcactgcgttcttcaagggatgaatccagagccctccatgaggccaagcttgtccttcaatcatgtttcctctcagatgcgtccgtgatgcctcctaatgtggaactggttgtccattgtttgggcctatggccaagtcacccagctgtggaagcagaggtagaagacgaggccagccaggagggcgacttcagtcacagctcccatgcctcagctttgtacctgttttcaaaagcacaactgaggtgtgcgggctggagctgtcttgcagtgattctggccttctggctcatggttcagtccagcagcctggctgacccactatttctcctctgcttcagaggaaacccaggaaatgcccttactgccaggctgagtctccacccatgctggttggtgctggctaggctgagggggccaccacttttcctggctagaagctacttgacctttgatgtttgagttctgtaagtcttcgtgttctgacttactgcttcagagggattggcctgtcccctttccctttctcggctatgggaaggaaggattgctcattggttgccttcatcagttacagcatgagacggaattcatcattccttccgaaacccctgatatttaatatttaatatttaaaaacccaaattatcaaaccattaagaactcattactggttctcagcctcctccagtactagcctcagtgtggctgctgcataagtatctgtagcctgtctacctcctgcagtggggccgctcgcctcttccctgtctactgctcaggctctcccacttcgtggcatccatgtaaagtaggtggcagggcagagatgtcactctcattcaacagggaggatgtctgttgctcagagaggttgtcctgaggggctgggtgattcctgggcctacattcttcccgaggctccaggccgctgtctctggaagtaaaagagccttgtctgaccttaatgcaagcagtctgtttgaacccctgtaggctgcattcaggagacagaaggtgtctgggccatcctgggcggccggtcagcgttgctaggcaggctcggctgtctggccgggacttgggcctgggtggcttttgagaccagtgaagaagggagagccggcctcatgccgatgcggcttgtggcacggctgggatgtgagggaggactcagatctacacacagaaacccctcttctccccgccctcccccagctcctacctgcctcccacgcctcaggtgtggctgcctgtgggaccatcccccaacccctttcctcgcacctccttgtcctcacccagttcctgcagtgtctctgacccacgcctcccgcctcctggccgacttgcccaggaggtgtctctggctcacctccgtctgttcatcaccttcctccccagtgtttccacttatcttggatgttttagattgaaacagcctgattcccggaagaatcctcttcattcattgctagtgcttcccctcacctcccactctccacttcccagtttgcaaatgtggctttcgcccaccaagtgaaagcggactgagagcagcccttggggacggcccggtgcctggctgcaaggccgcgctggggctctgtcttggtgcacatggcttgaccggactttccctgcttcccaccacttccctcactcccagacctccctcattctttttgtctcttctttttgcctaaagccagtccttaacaccctattcttcctctgcaggtggcttgcagacttttccccacctttggggctcgtggtggtggagagggcagctggtgttaagaatgtaggttaccgggcatgacccggcagatgcttgcccagtagttctggaggaaggcccgggaatctgcaaatgagcgcattccccaggcagttcccatgcaggtgatccacggaccacatgttgagaaactgcagtcacccttagggccacaccgtccctctcctcgctgtcccctctctgtagtgactggccctgaccttcaggagtgcactttccactctaccaggaagccctatgacatcctcaggctccccagacctgcagcttgcatggggcccctcccttcttccacacccaccctccgtatggtcccctgctctgccctcgtgctttgctggcccctgcccgctactcccactctcagacacccaggggtggtgggccctaactggctggcccctcccagcgctgccctctgccgtccagatgctgcagtgtggccagatttaccttccagtaacatacttctagtcacccctcctcctgcgaagtgatctgcagtggctgtttgaccagaccacaaagttcacatctcctgagcttagtgtccgtggctgtccacctcccagccatacttgactgtccccaaactctccctgcagccacatgtttcccatgacctgtgggctctgcagatggacctctctccgctagagatgcccttctcccaaatggcttccctcctggaaggcccagcctgagtcctcgtctcctttccagtgcttctgccagaagcatccccatgatgttgtgaccgcacagcactttgcgtctcgctttgagcacttgccactctggctggtgctgctgccactgattgtgtactgtcttgctgccctttctagactgtgagctcctcgtgggcagggaccgcctgtgttctctgtatttcccacggcgcctagcacagtgccttgcacttgataggtgcttaataaatgtctgctcaactg

SEQ ID NO: 881 - DNA, 3141 bp, Homo sapiens
ttttaaaatagggtttgaaacatgccacaggaaggttgctctccaaaaatacacagtgcagtgcaagaaaatgctatctcattggcctactctcctatgaattgctaaagtgcccacttcacatatgtgtttaaacctttataaaccagtatttcacttttaaaaagacaaggcatctctacccattaactctgcaagccactccacttgcaccattccgcttgaccctcctctctcctggcttgggtcaccagccaggcacctgtgacacgagtgctgctctccaggatctccactacatgttccaggttggagtgaggacgcgctatgtgctcacactcatgtgacatgaccaaagatgatactctgtaaacaaggcccttctgaccggactcagtgcgtgtgatggtgagtgcaatgaggaagggtggatattgactaaagactggttgttgttgttgtttaggttagtgtcacagccattacagcacaagtcaaagtcgccagttgaattttcattatgcacgtgtgtggtttaagcagtggtactgttgtatatcatattgtaaagtatcatactgccaagaaaataactcctagaaaggcattatctcacatccccatcttactttcctacatgttctcaaaacacagtagtaccagccttacctttctgctgtatgtagatagtcagatcatcctactgggggtgggatgaatttaaaagttataccaaaatttctgtaaagtctttgaaagtctaggagtaggtggtcatcttgtacatttcagcaaagcatccactaggaaacctcataggacagtgttagtggttcacgttctagtgtttttcctgaaatgtgcaatctactgtatagtattgccacataattgtacatagatgtattctgaatttgtggaatttcttgcttagatactattgtgtttgtttcatatgaatatttttgtaattctaaaagagatcttatttaaatttcctttttaaaagccgcatggttctgtgatccatgtaactgacactttttggctttcagtgctgtttagaaacagtggcaaaggcagggtggtgctgcctgcaagctgctgcctatggaaggcaaagtcatagtaatgagatagcacctctgaactgtgcagtcagcataccctgagtgatggctcaggggcgcactacctattttgtcaccagagctgactcaggcttcctggaccctcaaccccagatcattccaggcagcatagctttcttcacagtcctttcagaattcccaggctgaaatcagccatagcagttgacaaaacagctatccccacaagtgatgagatagtccctttactgtcctcaaatggacttggccttagagacgtggtaaagcactttggcagggtttaaaatatttgtgagaagcccacatttcagtatacatcctcactggcttccatgcacccacttgacggtagcctcacagaagtcctggctgtcactcaggtggggagctcatggtgccgctggggactttttagagaaatgtaaagagaatagctattcagtgtctactagcagagcaacatgtgtcaatttaaccaaattcacaaataaccctccatttttcaatatctgctactgtaaacatgaatattgaatactgacaagagaatacccatacaaatcgtcccaccgccctagaggccacagaattagcccaaaattatcaaagaacattaactggaaggtcaggtttttcaaggaacatagcttacaaatgcatcagtgtgtatctggagagcatcctaactgcatttcaactcatcttttaagtgatttcagtcaaaactggaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactttacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgt

SEQ ID NO: 882 - DNA, 2973 bp, Homo sapiens
aaaaaagttcgcgctgctggtcccgcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaagagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtccctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttgagacagtctcgctgcgacgcccaggctatagcgcaatggcgcgatctcggctccctgcaacctccctcaggaagccgtggaagctcgaccgccagaaacttccttctcctgactcaggccacagtcttctgtgtggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcaggacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttccggtcacggggccattccagggggcatcccttgctccgggtcccctgcagtgaggggcctgtgaaccccaccagggcagcagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactaaggacacctgtgtgccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaattttaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaaataaaataaaaaagtgaaagaagc

SEQ ID NO: 883 - DNA, 2523 bp, Homo sapiens
tatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacctgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggtcctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagt

SEQ ID NO: 884 - DNA, 3180 bp, Homo sapiens
aaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgccttttttttttttcgtactcatcactgacttgaagcttagtatctggcttccttaaggatgtaactttcatgtaacagattaataacttatatgaaaaccaacacaaccacatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagtt

SEQ ID NO: 885 - DNA, 3140 bp, Homo sapiens
tcgggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgttggatgcagcgaaccaatatcagattgaacctgtgaagaaaatgtgtgttgattttttgagagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaaccc

SEQ ID NO: 886 - DNA, 2364 bp, Homo sapiens
gatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagctccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccacctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttctgtg

SEQ ID NO: 887 - DNA, 2965 bp, Homo sapiens
acttctgtagtgtgcaggatttcgcgtaggcattaatagccaagggggtgggcgcgcccaaatccaaaccttgggaagaagaagagaaagaaagaaagaaaaaaaaaactttacagaagtttttttgtgtggttttcctttcccctccccactgtcaggtggcagtggtgttagcggcccggtacagggagctccggggagcgtgggtcggcaagcagccggccgccctctcctagccaagcggggcactgaaaatatatatggctggggcgcttcagaaccaccaccacctccaacatcatcatttctgtcacctccactccccgcagggcatcgtgccccggagagccccggggtgttagccgccaaagtgcgcttggggctcagctcctacccctctggagcagaacccccagcaacccacagactcagccctgcgccttccattaccccttacatctactctgccgctaccatccctctctagctcatggcgcggcgggggacttggcccaacagcaattcggcccaatggcggcggaggtgtttggccttgctctgtccaccgggttcactgctggcgctgtctggctctgagttccacggctgactgcagaggccgtagtgcggcagggctgggcctgccccccgtggcccagggaagagcgcgcagcccacgccacccgttctcatgcgcgctatttgtttcgacaacaggtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgaacagagggcgcgtttgggtttgatggcgagtttctaaaggcgaggaaatggtttgtaagaggggaaagaaaaggagaaaggtctaatcaagctcgggtttttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcgccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtg

SEQ ID NO: 888 - DNA, 3830 bp, Homo sapiens
gtaagctccaagcctcggggtctaggaggagagaagggagcaggaatcctccttccgaatgccaaccccgggagggcagggctggatcttccctggtggctgctccacctccagcacggagaacatagcccggcacacaatgaggagactgagagaagtaaaggttcattcccgaggagttgagggtaaacccagggtaaacctgtgccttcctgcttaccctcccaccaagctgaaaggggcctcatgcacagagaatgaaaaaaggtgatttgactttctgaggagttgacaaggtcactgccaaggtccacacctttgggttaaagcagggcatcccaaactccctgatctgaaggatcttccgggctgggtacaatacacatttcaatgcctgcccccaggcccagtgaggtgagattccctgcagcttgaatgagattcttcatttggagaaacagggggttaaggctctggaggccctgttgaaagcctggggttgggggaacacagggactcccttctcaccaaagggcctgaagtctgaaccaggccatcagaggagaacccggccgttaatcattcactcaatgtgtggtagagtctaagggccagggcctgtccgtgccctgctgtgcccagctagggagccggggcagctcgggaaggccctgacaagcaatcgactccaacttcctacctctgacagccacctgtccttgaatcctggggacgggaagctcagtcctcacagggccgacccttcccttgtgggctggctttgcagaacagaggtagcaatgtcaccttccccaatgcaccaggaagggtggtggtttaaagagaggcattttgatgagccaccagggccgactcctgatttattttccccattcgagctccagagtggagactgcgttctctctgccggccctgtggcagagggtgaaggaggtagtggctccggaaagaccatattaattagcttaatgagcacttgtgcatttgtgtgcacagacatgggaggcaagtgtgaatctctgtcaccgacatcattaattgctgggggtgcatctccccccacccaaaacctagacacttagagaaatgaatcaggcccagtctgggaacaccattaaaacacttggctgctctgggtgccggtccattgccctgtggctgctggggctctgtccttcaagaagaggctgctgtcaacacacacagtccctgcaggagcagcctccaagctgccttccagcaggggggccccaggccgaagcctggtcctctacagcttaggggagtccctaaggaggggagcaggtgtggggaaagcaccttccacccccagcaggagccacacactgagtcgggctgattatttcctgcagtgtgctctctgatgctgggatggagccccagccccaccactcaccagccctgagcccccacaaagtccctgttccttctgggtgtccctctcctcatctgtaagatgaggcttttctggcacctatggcacatgcccactaggaagatgaaataagatagtgaccctgaagcccttagcccagtgcctggcacacaggtaactgtcggcaatgttagattttttttactgagcattgttaacaaagtccctggcacatagtaggcagtgaattaggatttcatgtctttcagcaggtggaccttgtgtttggagatctaatccacgtgccatttctcactgacttgatagtttggttaaccaatgtttaaccttttataaataccatttgttcacatctcacctataaacaggcagcagcagccagccctcgctgtccaggcgcagcatcccagggtcaagtcaaattcttaaattggaagcccgaggagaatttgccactggctataaacacctccctcaggatccagacgctccctgcctgtctgcgtaggtgagggttcagggcctcctcaagctggttgggccactggtgctcccagtaccataagcaccctgcacgtatgtatgtcatgtatacgagcatgtatgactcttttcatagatgaggaaactgaggcgcagagacttgcttagacacacagctggcaagcagcggaaaggtctgaccccaggtcatttgtgaccacacacctggttttaactcaagaccctcccaaccaaaatcgagataatttcccctgaaacagtggcaggcacagcacttacaagggtgtgaaggggtccccttgcggctaggcacacctgggtgggtggtagagcagtatccatacccctggcttctccttgcaccttcattttaacccccattttatcagcaccctctttactccaagcactgggggaaacccagtggggtcagatgcacccgaccagcaattaaaagcaacactggctcttgcctcactctgaggatcagagacataattggtggggcccagtgcaaactgaaaatgcaataccttttcttcaaaaattaagaatttctagaggtcactgcagcatgtgggggtctgagccaagcacagggccctcctcaatgtggggcccagtgtggccgcactggttgcatagccatggagctggcccagctcctgctcacagcctggcacagactgggagcaaaatacatgtttattgagtgagtgaaatggcatgttcacccccaactctgtgaggtggactcaggatcatgaatttgcaggtgggtaaactgaggctcaggaagtttccagattcatcctgttctacctgaagcccaggtccctgcctcctaccactcttgtttgcccactgttccatgctgaccccaatcctggcctttgttttcctgatcccagaaagaagggatagtttaccatgggctggagtttattttatttttgtgttttccaataattgattccaacagttcctacagacagacgtcctgcagaaggaaaacatgttttgctcgctcaaccttcgacttcctcatggcaccacagtggtgggggcccatggcctcgaggaaagcgtggggtgacttttcccttggttatttttttccatctcactgttgggggacaacaaaacatgttttcctttttctccaaaggaaatcggaactttcttattgactactcattgcctaaaactcaccttccttctccgtgataatcttggattggatgagatgtgtaagttaacttcaaaataaaggaatgtccttcattttactaaaaggacaaccatcacaaccaaagatttcattcacatggagccaccaacaccactgaaattcaccgtggcttcctcgtcagtctgtgcacacatttgaagtggctttataatttcaagttcacacgtttgctcataatgttacctttttcaaatgcacagggctgagtgaacatacacattgccaatattctggtcaagttgaaatggctgcttagaggtcatggaaacagaattaggtgtatggtgtgaggaaggggtcaagaatctttttattcccatgtgaatgtccaatttatccaacaccatttatttaaaacaccctctctcactgtactgttgtgtctcccctattataaatttggcacttctatacatgttgggctagttctggactttcctttctgttccttgggtctatttttttatctttgcaccaagaccaccctgtcttaattactattgtatccactgaaatcaagaaatcatgctagacttagtaactctcctattgttgaacatttaggttgttgccaatgttttattataacgacttgtgtaatactgagtcatagcaataaagaaacaatcatagttg

SEQ ID NO: 889 - DNA, 3592 bp, Homo sapiens
atgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcaagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctgggggtggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctg

SEQ ID NO: 890 - DNA, 2542 bp, Homo sapiens
aaaaagagaaaaaggtgctgctgcgccttttcaagccttggacctttacgcccgcactttcctctgcccagaaagcttactgcttaactccagtacaacttactggtgcgcctggatccacccccgtctccactctgcttaagacacaggaggctgataggctggaagaatgaatagatgacataaaatagtcattgttatccccacataacttggcagcaagattgtggaactctgcagtcagacagatcgggttccaataccagttcttccacttactagctgggtaaacttccttcatccttctgagagttcaagaaacgtttgctgaacgaatgaataagatgttttgcagagataatgcttgtatcgtgcctggcccaaaatcagcgctcaatggaattactggtctccctactatatgcctgccaccttctctatttatgcaggttctgagttcctcgcagcgggggaacatctggctcggttctatctccccaaggcgctgggttcccagaagtttctagaatgaatacggagggctacatatttcacatgcgcggggcggggaaactgctgggcgattacagattcccgatggagctggccccttcgtggcgaccacaagtcctatcacgccacaagaatctcggcttgttcacctacaaatgaaggccgacgatacttgcagaccgagtctgacatctatgggaccccactcctaccctgcgcctcaggggccgggacaaccgtgacccgtaccgactcctcgcgcctccgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtgagcgccgcgcacgcgagcagccagagggcaggaagggtagcagggctggagcaagttctcatttcggctaactacaacagcatgcccttgaaggacctgcgtctatgctgttatcctaaaaccggatgcagagggactgtctaaaccctgatgactgctgaccaagttagtggccggcagatttgggcattcgtaatgctgtccacctcgggtttgaaaggaatgaagagagctaaatgtagaaacagcgcttgagagaagccttcacgcggggattcagtgcccctagaagaggctgcgccgcttttaaccttgccgatgacggttgcttaggtgaaaagaaacgaccttttgcctctgaaagggcggtaatatgccttaaaaagagcgggctagatctcaggcagtgtatttttttttccttccaggttctaatgatagccggtgctatctgtcgaaaggacaaaatgggtttagtggttgattgccatcagcccccgagttgtctagacaatggggtattggactcagctgggtcgttcagcagtcagttcagaaagagggaactgcattggatttaaggaaaatcctctctaattccctcgaaaaagcctaatggctgttcatttttgacaagtgacgggagatggctaacctctgacgcttagaaagggatcaaggaaggaaatcttatggggaagaaggccttagcaatgcttaaatttatggaaatatgattgatttccagtattatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggaaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgggaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcatt

SEQ ID NO: 891 - DNA, 3427 bp, Homo sapiens
cggaatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcaccttagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctcttcctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgctaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatataaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 892 - DNA, 2446 bp, Homo sapiens
cgcgactgcacctccaagcggcccggaacccgcggcttccctggctcccgtgagcatctcaccgggcggcactggccagcgccagccctcgggccggcccggatgaccagactcctgtagacacccgccgccctctcccggctcggcgcagccgccgcccgcgcgcgactcgccccgggaccccgcacaggttgaagaaatatggagatcaacacaaaactgctcatcagtgttacctgtatcagctttttcacctttcagcttcttttctactttgtaagttactggttttcagcaaaagtttccccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcggtggttctttgaagctctgaagtatcccaagttttctaaagctatcgttatcaatggaatactcatgacagtagtattcttcatcgtgcggattgcctcaatgcttcctcattatggcttcatgtattccgtgtatggaacagaaccctacataaggcttggagttttaatccagttatcctgggtcattagttgtgttgttttggatgtgatgaatgtcatgtggatgatcaaaatttcaaaaggttgcatcaaagtcatctctcacatcagacaagagaaagccaaaaatagtcttcagaatggaaaacttgattaaaagagtgctaccgataagcaaacttcattactacccagcatatctgctgataggatgaattcttggcatgtttttgtgtacctttcttaattataattgttattcaggatttcagtgtcattttttttaaaccttagaaaagagaaggccgggcacggtggctcatgcctgtaatcccagcactttgggaggccaaggtgggtcgatcactgaggtcaggagttcgagactagcttggccaacatggtgaaacctcatctctactaaaaatacaaaaaaaagtagctgggcgtggtggttggcgcctgtaatcccagctactcgggaggctgaggcaggagaatcgcttgaacccgagagacggaggttgcagtgagctgatattgtgccactgcactccagcctgggcgacagagcaagactctgtctcaaaaaaaaaaaaaaaaaagagagaaactaaaattaaaatttagttttcatcccaagatgtcttttctgcctttcttttgccttatttacaagcatggataaaaatcttaaaggtttaaataaaaatgatcaatataatggtgaatcttttgagaaatctcttaactgcattggtattttttctctgtgaaagatgactatgataatctggtacaaatggttttatgtcaccaattttgctgcaagaatgggaactgcttttaaatctgtaaatagctcttaacatttgttgtatgcactcttttcttactatggctgtcaacacttgtgtagggtttaatttctaaattgttggcatgttctttttctcaggctattcagaagtaacaacatttttcatttcagacatgcaatcacctattaatgatgaaatattttaccactttgggaatatttaattagtttagtcatggagaatacttcccacattttaagatttttcaaatatcactgtcatttctattttagcattttatcaaattattgcttttttattttataataaggcttaagacagattatagacctccttaagagatgagtttcttcttctaaaaatgcatgttgatagaggactatttaggctaatcggaggaatcattaagaaagaaagttttaacactgtttatccctatctgctttccttgcactttttctgtgaaaaatattttctgtttgcaaaatcttccctgagttctgaacccagcaccatcagtaccaaagtcttatgcaatatgtatttattatgctcctgaaataggcctcttcttgatgagacccaaactattacaaaaatatcagtattcatattttactcacaattcatacccgtgcttacttagttggcattttagtgctttgaatttctatcttaaagcacagaaaaaaaaaggtaatttaatccaagtattctatcatcaaaattattgtctgattatatgaagataaatgactggcgactctg

SEQ ID NO: 893 - DNA, 3624 bp, Homo sapiens
gttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccacgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagctgtgatggtttcacattgtcatcgtcgtccccccgggaggttggagcatcaggggcctggactcactggactctcccctctcagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccaagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgacttggggccggacagttcataaataattgattcctttccccactaaagcagtcgaggagatttgtaatccactttttagtgcaacaagagctccatgttatgcttgtaataaattatttacacgggagctgggctggtgtgcagtggcaggtcccgtcagaagagatgaggctcctgggacaggtcagcgtcaggggcagcctgctgtctgctctggagggcggcgctcacctctgggtcgcagtccccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacgtggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaaatggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagaggcagtccccatgataggcccattggtcctggggttgaccagtgagccagtaaattatcttattgctttaaacaagtttgtgcttaatctgtcccaactaaaatggagcttataaacttacttagcaagg

SEQ ID NO: 894 - DNA, 3302 bp, Homo sapiens
gaaatccaattgttctttatgaaacccaaataggattcctcagacccttggcactaaagaaaaaatatataccctgagacttttccaaaaccttaaatttgaaaatcctactagcatgtgattacgatgccccccctaaaacacagtatattattatatttttaggagagtcactacttaccataaactgaaaaattttaagaattaacatagacatgaagcctcaaagtaaatcaacgtattactattcgtcttggattctcaaaccccctgccctttgatgcgaaatgtaataaatacatcatattaatactttgtagttggcagggtagaagccagcttgaaaggcagatgctggccagacagctaggctcactcgctagcggaatgactcgcatctgcgaatttaaaagtcatgatacgtcatccaccttcaggattacttgtgaatgtttgcaacactggatattaattaaatccttaaatgctggatatctattgcacatatccgaacaatttgtggtgacactaaaggaatttttgtttcttcaggtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatactttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcggccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtggaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagagagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgttttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggctttttttttttttttggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctcc

SEQ ID NO: 895 - DNA, 3572 bp, Homo sapiens
aggtttgtggcgaccctgcatcaaacaagtctgtattggtgtcgttttccaacagcatgtgctcatgtcatgtctctgtgtcagcatttttttgcaatcacgtatttttaaattaagtatgtacattgttcttttagacaaaatgttattgcacatttaatacgctacagtatagtataaacatacttttatatgcactgggaaacctcaaaatgtgtgtgactcactttatcatgatggtctggaactgagtctgcagtatctccaaggtatgcctgtataagaagtgttatctaatttgaatattcatttacttaattattgggacagttaagcaatttctctgagtttaatggccaaagagaagtgtttttaatctgacagtctatatgatttcatgtggcagacctgataggccattggcaacagctccaaacctaattaaaacatagtgaggttcatcagggagagtattggccagagccatgaggactgccttgagttctagtaattgagaggagcagccacatctgcttttggatttacatagctggcactgaagctgaacagcagcagcagctcctcattggactccattatgtttcattgtagccaaacaattcatgaagtagacccagaaatttaggggaaactaagtcaagggccccattgaaccaatgggattgctttatgcagtggagttggccgtacagtttacctccaaaaggatagctgccattttttcatgtaggaccaaaaagctgctagggccaggccagctatgctatttctctttgactagcaaggcttgttagatacttttcaccttgttagtcatcaagtcgaagttgacccatcccaaaatggggatgtcaagccaaagagtcagaagacccatgttaagtcacattaagtttcaacaaaagcttagcagattaatagctgccttcttttgttaacatataaagatgtatgtggtggctgggtcaggcagctgttgtgattgttagtattgagctgttgcctctctgagtactcaggcagccattaagtctttgaaacttctcctcttggaggcctatattacttatactggaccacctggggagggaggtcagtctgtgccgtattccttgaaagtgagatggagtgagatatagaccaagaagtgcaggcataaaatccacgaattctattatacatacattgaatatgtccaaagaaccatggtgacattatttttgaggggtccagctcctcatcaaaaacttgggggctgggataggacagaagagagttggcactttctctagtttaacctcttgctatttcagtaagtgattaaagctttgactgttcgacgtgcctgctcagctctccctggcccctaacaatttcagttttccttccccactccaagccctgtccaaaccctgtcagttgaattaaagtgccttttttcctgtaggaacacagaccaagaagtttaacatgtgcatcaggtgctacagcacagattccaaaagatcaggttatcccccagttgggagttccaggtggcagaggaagctagtctacaatgacagtaggagcaatggtggtggggcatacagttcatctgctcataattgttatatccacacaattgtcattagtatgcctgagtgtttatgcttgcaaaaaaatgttattgcctatttcaatgtgtggagtggcctgcaaagtgttctcttgtgtttttatttttctcagtggtggtgggaaagaaatttgattctcagcatttttttccattgaccactgtctccaggttcagtacctgagcactgctgctacttcttcccccatctatctccagcatccaatgagtgtccagcttccaagaccccttactttggtgctgatcataatctcaaaatacataatcctgaatgttgaaatcctgaaataccaaaatccttaaggtctaaagtccctaacatctaaaatttcaatggattaaaatctttgaaatcccgtgagacaaattctggggaagggattaatgtgttttcagttgtatgcagtgtacttgcatcacgacaggcagaactattaccttgttattgtctctactaggaaattacagtttaaggggattcatataggtgccaaattgacaagaagtggacttatggacatagttttaggtgtcaccttgtctggattaaggaatacctagaaacctagtaaggcattattttcagtgtatctgtgagagtccttctaggggagacgtgtatgtgagtctcagtggactaagtgggaaagatctgtcctcagtgttggcaggagccgtccaatcagccaggggcctatagagaacagagaaggcaaattagtccctctcagagctgggacaaattttctgctgctgccttcgacatcagaaatttgacaccacaaactacattatcacagcattaaccatgtgtaagcattatgcatgtatgtaaaaatgtagaaacttcctcagtaaaggaagagatgtcctctttgtacatctgcatttgtcaaagataaaatttctgaaaatcttggctctttgggctaatgtgtatgtggtggtgacccactgaaggtttttggtttttttgtttgttttttcaagacagagtcttgctctgtcgcccaggctggagtgcagtggcaccatctcagctcactgcaacctccgccccctgggttcaagcgattctcctgcatcagcctctcaagtagctgggactacaggcgcccaccaccgcgcctggctaatttttgtatttttgtagagacagggtttcaccatattggccaggctggtcttgaactcctgaccccaggtgatccgcccatgttggcctcccaaagtgctggaattgcagacgtgagccaccatgcccagccaagttttgttttttgttttttgtttttttgttgttgtttccttttgagatggagtcttgctctgttgccccagcttgagtgcagtggcgtgatctggactcactgtaatcacctactggattcaagcaattctcctgcctcagcctcctgagtagctgggatcatagatgcctgccaccacacccgactaatttttgtatatttggtagagacagggtttcaccatgttggtcaggctggtctcgaactcctgatctgaagtgatctgcctgcctcggcctcccaaagtgctgggattacaggcatgagccaccacgcccgccccccccattgaagtttttgattgatctcgtcaggagacttaggttgtctatcactgtatttcagatgactgcagttataaagctgggtgtatgcttctatatatttagctttttcacccatttctttatgaatacagtttatctgctcataattgttacatccacgcaattgtcattagtatgcctgagtgtttatgcttgcaaaaagtatgttattgcctatttcattgtgtgaagtggtctacacagtgttctctagtgtttttatgtttctcaaatcccctttttaaaatgtaaataaatgctttttaaataactttt

SEQ ID NO: 896 - DNA, 3931 bp, Homo sapiens
atcccaggggaaacctgacggccaggttccctcgtgccagctgccgggaggcgggagggagtgccctgaaactctaatctcattgcctggccagaaaaggaagtaatccctagtgtcagcagattcagcggtactggtgtataataggatcaccaatatacaacaggaaaaaacaaaagtgaaagattatcaatatagattattgagtaggagtaaagaaggtaaatcaaaaaggggaaaagagattacagacacagaaaatgtcagacaacaaagaaaggaagagtcaaggatttcctaaagaagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagagggtctcgccccatcgcccaggctagagtgcagtagtgcaatctcggctcactgcaagctctgcctcccaggttcacgccattctcctgcctcagcctccggagtagctgggactacaggcgcctgccaccacacccagctaattttttgcatttttagtagagacggggtttcaccatgttagccaggatggtcttgatctcctgacctcatgatccacccgcctcggcctcccaaagtgttgggattacaggcgtgagccaccgcgcccagccttaatttaacttttaagttcaggggtatgtatgcaggtttgttatataggtaaatttctgtcatagtttgttgtacagattatttcaatagccaggtattaagcctagtacccattagttatttttcctgatcctttccctcctctcaccctccagtgtgtgttgtttccctctatgtgtccataagttctcatcatttagctcccacttataagtgagaacatccagtatttggttttctgtttctgcattaattcacttaggatagtggcctccagctccattcatgttcctgcaaaggacataatctcattctttttatggctgcatagtatttcatggtgtatatgtaccatattttctttatccagactaccactgatgggcatttaggttgattccatgtctttgctattgtgaatattgctgcaatgcacttacacgtgtatgtgtctttatgatagaatgatttatattcctttgggtatataatcagtaatgggattgctgggttgaatgggattctgtttttaagtctgaggaattgccacactgtcttccacaatggttgaactaatttacactcccaccaacagtgtataataagtgttctttttctctgcaaccttgtcagcatgttttttgtttgtttgtttgttttgttttatttttttactttttgatactagtgatgatggtatctccttgtggttttgatttacatttccctaatgatttatgatgctgaacttttttttggtagtttaaaaggaatagcatcaaatctatacattgctttggatagtatggccattttaatgatactgattcttcctatccatgagcatggaatgtttttccatttgtttatgtcatctctaatttatttgagcagtattttatagttctacttgtagagatcttttaccttcctggttggctgtgttcttaggggtgtgtgtgtgtgtgtgtgtgtgtggcaactgtgaatgggatttgactcagtttgattggtgttatataggagtgctagtgatttttgcatattgattttgtatcctaagactttgctgaagttgtttatcagcttaagaagcttttgggccaggactgttgggttttctagatatagcatcatgtcgtctgcaaacagggctagtttggcttcctctcttcttatttgtatatgttttatttctttctcttgcctgattgctctggctaggacttcgaatactatgtcaagtaagagtagtgagagaggggatccttgtcttttgctggttttcaagaggaatgcctctggtttttgcccattgagtatgatgttggctgtgggtttgtcatagatggctcttattattttcaggtatgttccttcagtacttagtttattgagagtttttaacatgaatcgttgttaaattgtatcgacagtcttttctgcatctattgagataattcatgttgtgtttgtcttcagttctgtttatatgatgaatcatatttattgatttgcatatgttgaaccaaacttgcatcccagatataaagcttacttgatggtgatggataagctttttgatgtgcttctggattcaatttaacagtattttgttggggatttttgcatcgatgttcatcaaggatattgacctgaagtttcctttttgttatgtctctttcgggttttggtatcaggatgattctggcctcatagaatgagttagggaggagtccatcctcctcaattttttggaatagttttggcaggaatggtaccagctcttctttgtatatctgatagaattcagctgtgaacccatctggtactgggcttttttcagttggtaggctatttattactgaattaattccagagcttgttactggtctgttcagagattcgatttcttcccggttcagtcttgggagggtgtatgtctccaggaatttatccatttcttctagatttcctagcttatgtgtgtaggggtgttcataatattctctgatggttatttgtatttctgtggggtcagtggtgatatcctcctcatttctgattaggtttattttgatcttctctattctgtgttagtctagctagcagtttatctgttttattaattttttcaaaaaaccagctcctagattcactgatctttttgaaaggtttttttttggtctcagtctccttcagctctgattttggttattgtcttctactagctttgggcttggtttgcttttgaactttttcatttcaattctattacttctaattcatttaaaagttgtcctcaattcagttaaaaaatgaaaagttaagaacttaaagattcttcacaacaaattatgaagctgaaggaccaatatagtcagaccattttcttaaaacgttacatttttgtgaataattttatttattccatgatgagaatcgatcattaatatgagtaaccttcttctcaaaacaaccagcttttaaagaaggtgaattccaataccaaaagatttttattacttctttttggagtcttttttctatctcttctgaatatctttagccatggccttgttacagttcaagaatcatcttttgcctggactacagcattattttgttctaattattttaaatattgtgttttacatattttggttctcatattaatcttgcttttacattttttggttcataaaaataaaaaatgtttttttg

SEQ ID NO: 897 - DNA, 3601 bp, Homo sapiens
agagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccatgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacataaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagc

SEQ ID NO: 898 - DNA, 3579 bp, Homo sapiens
ttaacagggacagggtagtaaaagggaacttgcatggtttactttataaacttagctatgatttgaaactgaatctgttcaaggattacatgtttgaaaaaaacaaaacgtagatggtttgagaaagctgtgtggatggggacagactgtgctcatttggccgaggtggggaggacactgctcttcctcagtgagtcctttgggtccccctcgaggggtcatcctgaggtcaggaaggggtactagggtgaccttctctgacacagtcctcacagggcagggatggactgcacccctgagccccagcttttcccagtggccgccaaggttttcttctcccacgatttctccacaccctgctgctccagtttgaacctctgggaagagcaaggtcacttctttggggggtgtgggtcagtcagtcatggcttagcactttgtctgcctccttcagtccaggggagttgcttgtcctagcgaccaagatatggggtttgtggccacattcagtcattttcagcctccacctttccccacagaaggatttccatgtctgagggtggcgttccctgcttcccaggcctgggccccctttggagatcaggtgtggccccctgtgcactcttgaccaacacgcagtcaccacacccagcccactcttggcacctccggggcaccctcttctcagtctctcttgttgccaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccagggcttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctgctgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcgctcaataaatgtttgtttaatg

SEQ ID NO: 899 - DNA, 3242 bp, Homo sapiens
tttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtaaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaaggataattctggcctcatagaacaagttgggaagtgttccctcctcccctattttctgaaagtttgcgaagctttggtattatttcttctttgaatgtttgggagaatccaccaatgaagtcttctgggcctaagcattactttggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatattgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccag

SEQ ID NO: 900 - DNA, 2516 bp, Homo sapiens
acaccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttacccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcctgggttctacccctaatgcaaatacccaccagggagatgtctagaggcagactcctgagtgaggtgttgcagcccaaaggctgcagcattgccataccattcccatggagttgccaactattctcaggccgagggccatggggaagatggagcaaacctagcccccaaaccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccggatcccgtcggcttctcgacccacgcagaggagccccgggcttggcggctctagccccagcgccaaaggagacccgccccagggccgggctttgcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcagtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctag

SEQ ID NO: 901 - DNA, 3342 bp, Homo sapiens
gttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcaccttgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaaagattacaggttggtagaatacttgcaagctatgaggaattttttcttaatggagggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgttttttgtaaccattttaaacaaagccgtctgtagaggatcctttccccattgtgagtatatcatgttaaaatatttctacctctgtatttccttgtaactaagtgtatgtgtcattgttttgttactgatcccatgaagaattagaaattctcaccattttcaaaactgaaaagtcccttagcagttgtcccatgctttgaattgctttttaagcattacggtgaggtgagtgtaagcctgaggatcttactttctggtataccatttattacaacagatttctaaaactcctattaaataaagttgatggcagaatagatttctgtcacacttc

SEQ ID NO: 902 - DNA, 3620 bp, Homo sapiens
atgtgggccccggggcgtgggttgagctcggtcttcccctgaggccgcgcggagctgggcgactggggcgaggactcgcgcacaggtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggaaatgcttccatcaggtagaggcattttaggtcgaggcttgtctgctaatctggtacgcaaggacagggaggaactctctcccactttttgggatccaaaagtgttggcggctggggacagcaagatggcagagacctccgttggttggagtaggacgcttggaagagggagttcagatgcgtctttattaccactgggaagagcagcaggtggtatcagcagagaagtggacaagcctccctgtaccttcagcacaccgtcccggggtcccccgcagctgtcatcaccaccagctctgccccagtctcccctgcactctccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacagacagtgctgaaatcagcattaagattcagatgacaaagatcctggagccctgctctgacctgtgcattcccttctacaatgttgttttccgtcgggtaatgaaacttttagatatgaagcttgtggggagaaacttttatgaccctacaagtgctatggtactacagcaacacagattgcagatctggccaggctatgcagctagcatccgaaggacagatggagggctcttcctgctagctgatgtctcccataaggtcattcggaatgactgtgtgctggatgtcatgcatgccatttatcagcagaataaagaacacttccaggatgagtgtactaagcttctggttggcaatattgttatcacccgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcactttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaagaagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtgggtggatttctatcttcttgcccatcatgtacggcagggctgtggcattcctacgcattatgtctgtgttctcaacaccgcaaacctgagccctgatcatatgcagaggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagcttggagatgggctggtgagaagaaaggcggcctcagaactcagctgtgactcttgcagaatcaacagagactgaagtgggcttttgtgttataattttccctttctccaaccctgtagaataagatttctttcttgtcttttaaacctaatatcaccaagaagcaagtttctgagtaacagctgaaaatggccttgttgcctgtgtagagcaagttacggtggtactgccactctgcaggtggagcgggtgactctgggggaccattaagacctccagaccgggtgcggtggttcacacctgtaatccaagcactttgggaggccgaggcgggtggatcatgaggtcaggagatcaagaccatcctggccaacatggtgaaaccccgtctctactaaaatacaaaaaaattagccgggtgtggcggtgcacgcctgtagtcccagctactcaggaggctaaggcaggagaatcgcttgaacccgggaggtggaggttgcagtgagccgagatcacgccactgcactccagcctgttgacaaagcaagactctgtctc

SEQ ID NO: 903 - DNA, 3838 bp, Homo sapiens
aaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgcttaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagatttt

SEQ ID NO: 904 - DNA, 3159 bp, Homo sapiens
tcaacatatgacgatgttgaaccagctctatcagctgcagctggcataccaacgtttacaaatccagcagcagatgttacaggcccagcgtaatgtgtccggatccatgagacaacaggagcagcaagttgcacgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaagg

SEQ ID NO: 905 - DNA, 3418 bp, Homo sapiens
aaaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaatacaaaatgtcaaaaattagaaggaaggtcacagtggaaaataccaagactatatctgatagcacatcccgaagacccagtgtatttgagaggcttggacccagcactggcagtacagcagagacacagtgccgtaactggctgaagactggcaactgcctctatggaaacacatgtagattcgtacatggcccttcacctcgtggtaaaggttatagcagcaattatagaaggtcaccagaaagacctacaggggatcttagagaaagaatgaagaacaagcgccaagacgtggacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgataatggagatattaattatgattatgttcatgaattgtcattggaaatgaagcgtcagaagatacagagggaattaatgaagctggaacaagaaaacatggagaagagagaagaaattatcattaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccatgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagtcgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagatagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtaaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagc

SEQ ID NO: 906 - DNA, 3044 bp, Homo sapiens
attcactgattagatccagcgctgagaggcagcactgctccttctctcacgccaactgagtctcttgatctgtacatgcaatcccaggcagctcgcgaacacaaacccggggccagccgcctactgctgctgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcgagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacccgttccagctctgttcccagggtggggcagggaggtgggggttgggggagtagtggggcacggctcctaagatccagcccccatactgacagacggacggacagacatgcaaacaccagactgaagcacatgtaatatagaccgtgtatgtttacaatgttgtgtataaatgggacaactcctcgccctctacctgtcccctccccctttggttgtatgattttcttctcttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 907 - DNA, 2719 bp, Homo sapiens
gcactgacggcccatggcgccgcccgccgcccgcctcgccctgctctccgccgcggcgctcacgctggcggcccgacccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacttccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcagggtcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgcaattcaggactcggaagtgacatcactcatctggtctcaggggcagcccagaagtatctgactgtagacacaactaggctccgtgggcatatctgggtggcaatttcagagggcagaggggacaccttcattgcctctcctcgcacagaaatggtgggctctctctggcccagcgtggtggttcatgcctgtaataccagcgttttgggaggctgagatgggaggattgcttgagcccaggaggtcgaggctgcagtgagctatgatcacaccaccacactccagcctgagcagcagagcgggacctcgtctctaagaatagaaagaaagaaagagaaacggtgtcctccgcacagccggtcagaactgtgtgactcacttgaggcaggaccgagagtgacatccagttgcacctttctcacctactttgggacctttgggggtgagttcccctttgtcctctcgtggaaacagcacacagcaagcaaccacaaaaccagagcggaaggagggacttcccaccggcatccggccccagtgccatgttttatcatctggaacggttgtgaagctttgtgtgacttgctcaggatcagcagtcaccatggtctaatcccaagagggactcgtcacccagagacctcaaaaggccccaggcctactgtggttttttctgagaggctcccagaaccaagtggcacgttggtttcctgtgcgtctgtgtctttgtgcctgtatctcgctgggggacttcacaggaagcaggatttgggcattcctgaagctcccagctggacaccactcctgagcgccacatcccatgatcacttcaaccacaggcctttgacttcgccacatggcaaggcacccagcagaagatgaggatgacgggtgatgctagatggatgtgtacctggtggatggcccacgcacgaagactcaagaccctcaggactggccatataatctgcaaggtccagtatgaaataagaataagcagcccacacaactgggcatagtggttcatgcctgtaatcccagcactttgggaggctgaggagggtggatcacttgaggccaggaattcgagaccagcctggccaacatggcgaaaacccatctctactaaaaatacaaaaattagttgggcatggtggcacacacctgtaatcccagctactcggaggctgaggcacaagaattgcttgaacctgggaggcggagtttgcagtgagctgagataacgccactgcactccagtgtaggcaacagagtgagaccctgtctc

SEQ ID NO: 908 - DNA, 2800 bp, Homo sapiens
atcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcattgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgctgtgaagaaggcagctcttggcctcccactcccacacttctttgcctataaatcttcctagcagcaatttgagctacctgaggaggaggcagggcagaaagggcaagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 909 - DNA, 2992 bp, Homo sapiens
tcatgagtgctcacctggtagagggaagaccctgaacgtccagaccgttcccctgaccggccacgtgtggactcttggtggctctgctgtctcagcccagcctttccgtggcctgacactgattgtgtgtctgagttttctgaatgtccctcactgtcactggcctgactaccgctagacccccggtgtccacgatcgctgactgcagatgaagcttgcccgcgcccagtggctgagtgtctggagctgtctgctgactgctggtggccggatccatgtctttctcctggacttgatcttgcctgttcatgggatgatgcagtctgtccacgagaggaagtctctgcgtgacgagtgcctgattgtctggagctgtctgcagagtgcccatgactggctctgtcttcatcatgggacctggggtgtctggagccatctcttgactgctcccacgcagatccatgatggtttctggaagccgacccagagtgcctctcagagtcttctgagtgtccctcactgtccctgtcctggctaactctggatcccctacgctttcttgtcctggactcctgcaatgactcataatatgcttgagccaacttgaataccatcagaagaaactcagtgaagtcaattttcttgttgtggtctatatccaagtgatccatgaagacatcaaccatatctgggtcatctggattctgtacagagggaagtcacagagggagactgcatcagacagaatcacattatcagccaattaattcaaagttaatttaaggaacctgatctttgagtattaaaaagtgggacaaaatctttttttttttaagacttttttgtctcatcctcattcaggtgttatatgtgaacaaagatgtagactagtaaggtatcaagatttgatggggatatccagacaacttggagccaagtccccacagctggatcagacaacttttggtgacatctcacagtgtggattatcaagccagtgtatcagtctggagcctaggtttttttgcctttagctttgctcaggatgacttctgctcttctatggcaatacttgagaagctacagctttgattagacgagaggctatttcaataactttctcctgataagaagaccaccgaccgtggacggattctggccagtttacaaaggctgcataccatagggcagggcaccccactatggcaaacactaataatgatattgctcctgattttgtttctgaagggaatgcctctaagatttcttcattaattataagagactgggtctcactctgttgcccaagctggagaacagtggcaccatcatagctcactgcagccttcaacttctgggctcaagtgcttctcccacctcagcctcccaagtagctgggacaacaggtgaaattgaaggccagcttttggaactcaaccttcaaaggaacttaaaatttccattatgtagagtccctgaggaaactggatccactagctacactggctgagaatgctctcaccccaggatttcatttttattttaccacatcattgttggtatcttaagatcaatgtactggagcagcggggtctcacaaagaggatacctggtgacacgcccaggctttcagaatgcactatagggctttagtgacttgtccaggttcagctgaaatgtgccatctgggacctactaatgcttgttgaactttactggatctcagaagctgggtctcagaagctcagatgttcctcagagctacgatatcaacaacctgtgatgacagagagaaggttgctccatgatggatttggaaacttactggctagctaaacctgactgaatgggaaggaatgtggatagctttggaactctagtttcactagatgagctggaatttgtattttgacaaattgcacgttatgattattaagtaatgcaactgatttttttttcccttaaaacaaacaatctagaatctgtgtaatcaaaataatttctctaaaaggctgcaagtatatgcttaaagtgttggggcattcagagcatttggaacattacattcttttgaatgtcaattggtagatgaaaataccagcttttaagtcatacatttgattttttgaaacaatatgcatttagagtttgtaagtcaagtgaataactgataaggtaaaaaaaagggggagttcattgttgagtatgaatttaaagtaaccagactgccttttgtccagtggctgtcagtaatttacttcagcaggcattttttttttttgaggctgttctatgatatcatgacccttcttgtaggaatgtgcttccagtggtgaggcagtctgagaatgtgtgaagcagtataatgaagccagaccaagatggaagcttggcctgggatttgagcatcaggaaaactgttgaagggttatgtatacatcacacacacacacacacacacacacacacacacacacacacacactctcttccatactcctataacaacgtatagtatttactatacctggtgacaggtatttactatacattgttgaagatctataacatggaatgcctagtgctaagtgcagtgtccttagtgaaattgtattggtttggaattatttatgagtttgggattatttgtcactacccttaaatgatcttgacactcacctatttgaaaagatattgaggatttgccatttgatattgaccagggtgtattgtgcacaaatattgtgaatatacatctgtctgtccttaaatcactgtaagttttaactggaatagatttgctccacattactcggtagggctgatatttcatgcctcatggatgagaaaagaataggcaaaaattatatctcgggctgcctcacacatcttttaacaggataagggaaaaataaatataagacctatgagttatggcatcaggcttgaactttaatttatgaattaaaccaacaatattattgattattgc

SEQ ID NO: 910 - DNA, 3104 bp, Homo sapiens
agagtcatgtgactcgagtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagctggtccgggagttcgtggcccagaacaataccgtgcaaatcaagcatgtgatccagaccctgtcccaggagtttgccctgtctcagcacccccacagccggaaagggggcctcatcggcctggccgcctgctccatcgcactgggcaaggactcagggctctacctgaaggagctgatcgagccagtgctgacctgcttcaatgatgcagacagcaggctgcgctactatgcctgcgaggccctctacaacatcgtcaaggtggcccggggcgctgtgctgccccacttcaacgtgctctttgacgggctgagcaagctggcagccgacccagaccccaatgtgaaaagcggatctgagctcctagaccgccttttaaaggacattgtgactgagagcaacaagtttgacctggtgagcttcatccccttgttgcgagagaggatttactccaacaaccagtatgcccggcagttcatcatctcctggatcctggttctggagtcggtgccagacattaacctgctggattacctgccggagatcctggatggactcttccagatcctgggtgacaatggcaaagagattcgcaaaatgtgtgaggttgttcttggagaattcttaaaagaaattaagaagaacccctccagtgtgaagtttgctgagatggccaacatcctggtgatccactgccagacaacagatgacctcatccagctgacagccatgtgctggatgcgggagttcatccagctggcgggccgcgtcatgctgccttactcctccgggatcctgactgctgtcttgccctgcttggcctacgatgaccgcaagaaaagcatcaaagaagtggccaacgtgtgcaaccagagcctgatgaagctggtcacccccgaggacgacgagctggatgagctgagacctgggcagaggcaggcagagcccacccctgacgatgccctgccaaagcaggagggcacagccagtggaggtccagatggttcctgtgactccagcttcagtagcggcatcagtgtcttcactgcagccagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaacggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgccgcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctc

SEQ ID NO: 911 - DNA, 3503 bp, Homo sapiens
aaaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgacggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaataataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcgtttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggagctaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgtt

SEQ ID NO: 912 - DNA, 3744 bp, Homo sapiens
gagcggaagcggaagtgaacgaggcggctgtggcggtggctgaggcggctgggcctagggtgcagcgggcgcgtctgcggctggtgttggcgcatctctagatcctttcccggagttcagttatgggtgtgagaggtttgcaaggatttgtgggaagtacctgcccacatatatgtacagtagtaaatttcaaagaactggcagagcaccaccgaagcaagtatcctggatgtacccctaccattgtggttgatgccatgtgttgtctcagatattggtatactccagaatcttggatctgcggtggccagtggcgagaatacttttctgctttgcgagattttgttaaaacttttacggcagctgggatcaagttgatattcttctttgatggcatggtggagcaggataagagagatgaatgggtgaaacgaaggctcaagaacaacagggagatatccaggatttttcattacatcaagtcacacaaggagcagccaggcagaaatatgttcttcatcccctcggggctagctgtgtttacacgatttgctctaaagacactgggccaggaaactttgtgttctttgcaggaagcagattatgaggtagcttcctatggcctccagcataactgtcttgggattctgggggaagacactgattacctaatctatgacacttgtccctacttttcaattagcgagctctgcctagagagcctggacaccgtcatgctctgcagagagaagctctgtgagagtctgggcctctgtgtggccgaccttcctcttctggcctgcctccttggcaacgacataatcccagagggcatgtttgaaagctttaggtacaaatgcttatcgtcctacacctctgtaaaagagaactttgacaaaaaaggtaacatcatattagctgtgtcagaccatatatcgaaagttctttacttgtatcaaggtgagaaaaattagaagagatattacctctgggactaaacaaagctcttttttataaaggaatggcatcatatcttttaccaggacaaaaatctccatggtttttccaaaaacccaaaggtgtaataactttggacaaacaagtaatatccacgagttcagacgccgaatccagggaagaagttcccatgtgttcagatgctgaatccaggcaagaagttcccatgtgtacaggccctgaatccaggcgagaagttcccgtgtatacagattctgaacccaggcaagaagttcccatgtgttcagaccctgaacccaggcaagaagttcccacatgtacaggccctgaatccaggcgagaagttcccatgtgttcagaccctgaacccaggcaagaagttcccatgtgtacaggccctgaagccaggcaagaagttcccatgtatacagactctgaacccaggcaagaagttcccatgtatacagactctgaacccaggcaagaagttcccatgtatacaggctctgaacccaggcaagaagttcccatgtatacaggccctgaatccaggcaagaagttcccatgtatacaggccctgaatccaggcaagaagttttaatacggacagaccctgaatctaggcaagaaattatgtgtacaggccatgaatccaaacaggaagttcccatatgtacagatcctatatccaagcaagaagactccatgtgtacacacgctgaaatcaatcaaaaattacctgtagcaacagattttgaatttaagctagaagctctcatgtgtacaaaccctgaaattaaacaagaagaccccacaaatgtggggcctgaagtaaagcaacaagtaaccatggtttcagacactgaaatcttaaaggttgctagaacacatcacgtccaagcagaaagctacctggtgtacaacatcatgagcagtggagagattgaatgcagcaacaccctagaagatgagcttgaccaggccttacccagccaggccttcatttaccgtcccattcgacagcgggtctactcactcttactggaggactgtcaagatgtcaccagcacctgtctagctgtcaaggagtggtttgtgtatcctgggaacccactgaggcacccggacctcgtcaggccgctgcagatgaccattccagggggaacgcctagtttgaaaatattatggctgaaccaagagccagaaatacaggttcggcgcttggacacactcctagcctgtttcaatctttcctcctcaagagaagagctgcaggctgtcgaaagcccatttcaagctttgtgctgcctcttgatctacctctttgtccaggtggacacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggggaacagacgcatcactggccgagcccactggggctcacaccacgcaggtgggaaagggccaggtgcctctagaagccccacaagcgtagaccctaactgcttcctgagttttgttgataaatgaattctaagaagaggctgatataattggatgaacagaatagaatttaaatgatagggccgggtgcggtggctcacgcctgtaatctcagcactttgggaggccgaggcaggcagatcacttgaggtcaggaattcaagaccagcctggcccacatggtgaaaccccgtctctgctggggatacaaaaatgaaccgggcgtgttggcgggcgcctgtggtcccagctgcttgggaggctgaggagggaggatcacctccgcctcccgagttcaggcgattctcttgcctcggcctcccgagcagctgggactgcaggcttgtgccaccacgcccggctaatttttgtatttttagtacagaaggggtttcaccatgttggccaggattgtctcaatctcttgacctcgtgatccgctggttttcaaaaaccaatttggtagatgaaaaatctatctcattgattgaatgctgctttgtctgtcagtgaagttagatatcttattagtttattttgttaatgagactttttaattattctttcatgccctccttcagttcatgtttacacctgtaactactgcagtcccattatttttcttgatggaataggagaactcagcccagattcttatccacccagactatctctaggagaactacttggtgtcagccttgcaaataccattctcagaggtttcgtgtcatggggggagtagccgcctcagatgcacccagatcccaccaggtgtcgtgcgtagcaccccatgaagggagagcagccagggtgtgtggaaccatgtccaaccatgagagggaaggctgctttttctactgttcccaatccttttctccatcttttgactttctgccaccaactatagatagacagagattgagacccccaaaacaaagttgatttattgcaaaataaatgtgtgatactctctc

SEQ ID NO: 913 - DNA, 3587 bp, Homo sapiens
ttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggtgcacccattttactaccagatttggaaggaacgaagttaagtaatttccaagaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttgagcaaatgcctccgcattttatgcaccttcaacctccacagccaaaggcccccaagaccaaacatgctgtgcacacacagcagctctttgtgtcccactcctggccgatctcctgcatcatctcgttgagcttcattgaaccccgcagtctgcatgctctgtggaactcagggtcttcattttgcatgaaactcagggtcttcattttccgtggaactcaaagtcttcttgctctgtggaacttggagtctcagggcctttgtgctccatggaacttggggtctgtgtgattcatggaactcagaatccttgtgctctgtggtactcagggtgtgcgtgctctgtggaactcggggtctgcatgctccatggaaagcaccaggatgcacttgaccccccacacccatacatacatccttcattttattcctggccctcacctgtccactctgtgaggcttcttcacccccactctcctttgagctcatgccgggtctttcagactggcctgaagcatgggtgttcgtaggggggagtggctgatgtcacaccttcaggcaaattctgctagtgtcacacctgatggagctgcctagggaggatgtttccttggaggatgcgccctggcagccactggcttcttacggtgcctgcactgctgctgctgccatgggggtgccacagggccacactgggggctgttctggaattggtggttttcatttccaggttaggtagggactggcaggcaccttggctgtccttgtggcttctgtcttgaccctggtcctccccaggcagctgattttctgggctgctgctcttccaggaagaattaaaggtgggaatggctgaaacctcagctttggattcacagagaccctaggctgtgtcatgcagaaagggaaaggattgcagatggtggtgggatcagccgaaggcagggccttcactgtgatgctggagccctccatgctgggatgtttgcatacagcccaggttcagttcggtggtccatcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaggtgttgtgtttcattcctgtcaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgactcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaactttatgcttctttcagc

SEQ ID NO: 914 - DNA, 2914 bp, Homo sapiens
acagctgatccggttcttgcggcggtgcgtgctggcgccggagagttccgcgcgtgtcctcgggctgtccgcggggaagctggtccgggagtgggcgcccgcccgcctgcctcgcgccttgcgcccccggcaccgcttccagaagggaaagtcgccgccgctcgcggtagacccgggcagcgcttccattccgcggagctggaaataggaatccagccatccgtgggtcaggaggaatggagactgtaccttccacatagattcacaagctgccctgcagtggccttggcttcaggaaaggagcattcagacgcttccgtcagcctcccaggatggcagcccctgacctggcccacggaggtcatgtttctagggactcagtctgccttcatgaagaacagacacaggcagcagggatggtggctggctggctgataaattgttaccaggacgcggtgacctttgacgacgtggctgtggacttcacccaggaggaatggactttactggacccatctcagagagacctctacagagatgtgatgctggaaaactacgagaacctggcctcagtagaatggcgacttaaaaccaaagggccagcacttcggcaggatagatcttggttcagagcatcaaatgagacacagacggcaagaagccacaatggagggcagctctgtgaccgcacgcagtgtggagaagctttcagtgaacactcaggcctcagcacacacgtgagaactcaaaatacaggagacagttgtgtgtctaatcattatgaaagggacttttttattccatgccagaaaaccttgttcacaattggagagcagttttccgtgttgggtcagtgtggaaaagccttcagctctactccaaatgttgtttcccagcaagcatgcactcgggacagatctcttgactacagcagctgtggggaagtgtttcttaatcagtcataccttcaggcacgtgcgggaagtcacaacggagaagaaacatggaaatggaagccgtgtgggaaagctctaactcactccatgggctgcgccacacctgttgaaatgcatgccgtcaggaatccccacgtatgtagggaatgtgggaaggcctttaggtacactgcctaccttactggtcgcgtgcaagtccaccctggggagaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaacccatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaaagattgtgggaaatccttcactgtttcttcaagcctgactgagcacgcaagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttacatgtacggtatgcaggaaatccttcagaaattcctcgtgcctgaataagcacattcatattcacactggaataaaaccttatgaatgtaaggactgtgggaaaacattcactgtttcttcgagcctaactgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcatacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttacactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccctatgcagcagacacagagaaagccctcagtgttctctaaggtcttgctgaatatggatggtatccagtagagagaactctattgatgtgtgatatgcagcagcattgttgctgttctgctcagtactttgatgatcccttgtgatctcacaatgaagaaaaaccttaggagggtgagaattgttgggaagtcattttttacattacatctttcctcaccctttagtaaacgtggtgattgac

SEQ ID NO: 915 - DNA, 3213 bp, Homo sapiens
gaaaagcctgcatcatgtgggaataaatgaggctgcatgtgatcaaatacccggaaaacaatggcgtaaaccagagcaggggctggggctcagctgtggccggacacccaccacgtgcccatgggatgcttccaggtccccttctagaccagcagaagcccaggacacctgaccgccactggacaagcacatggggaaaatgagccccccttctccacgggttccccaacacctcagaagtccaggaagacacagtgatgattcatacattttgccaaagagggatgatttcatgaaatctccaaatgatcacgataacatcccagccattagggatactaagccagccaccgaaattggcagagaagccctcatctttgagaggagtgggaagcaacacatatactctatgtccagaattagaatccatactggcatgctgttcctatacatcaacccgaaccccagcccccacccccactcactggaggcagaatggtgtgggttcagcctcagctcagatgctcactagccagaagaccagaaagcacctacctccctaagcaccaacctcttcatctagaacatgaaagtcacatccttctcctgcctctgtccccaaagtgagctaagctcagaagagccaagcccaggaaagtatttagaaaatggatccattgaacagctcttccattgcaggtcagattcttcaatgaattctttaattgaaccatttgttaactaatatcatgtgttggcttttggttttactatgttttagtacaaatatccagggacaaactcttcagctgactacatctgatgactaaattgttcaattgcttctgtaattttctctatcctggtgatgacatcttgagaggtgaagccagctgtgcttctgggtcaggtggggacttggagaacttttctgtctagctaaaggattgtaaatgcaccaatcagcactctgtgtgtagctaaaggattgtaaatgcaccaatcagcattctgtaaaatggaccaatcagcactctgtaaaatggaccaatcagtgctctgtaaaatggaccaatcaacaggacatgggcggggacaaataagggaataaaagctggccactgccagcctcctgcgggaacatgctcaggtctgttcttttgtcttgattataaatcttgctgttgcttactctttgggtccgcaccaccgttaagagctgtgacactccccgcgagggtctgtggttgcgttcttgaagtcagcaggaccagaaacccacgggaaggaaccagttccggacaaaatctcaggcccagtcaactgtcacctgaccccaactctagccagactcagttttaagtcccgtcgactgccacctgaacccaactcaagccagactcatttaagaggagagtgagcaaggccacaccccctccctgttgccagtctctttgtgcgtgggcaactggttctgcaaccagttcatatgtcaatgggccattaatcgtgctgtaaaacgggccgtaaaataccccaaatcatttattccactccctcttgccctgtgaaaatgacctggtgagaagaagcgtgaagggggaggtgcttctattttgctggaccctcgctctgccaaccacccgtcaccacctccccactgaaatacccgtggaggagccttgggagccaggactgtggatcagtgcttcgccgcagggatttctgtctcccacggtgtggtcagtgagctggagtgcgaccaggtccccactggcacctctctctctttgggttggattcttgcaactgagaccccctagccgcagcccccctctgctgtgcgtctgccactttccgggccatgaatacatgttcatgtctacaccacgctggaaccattttctgtcccacctcgggactgggtggcacgtgagagtggccagggagagaccgcatctgggaaggcacagctggctgcagggaacggccgccctggaagagcccgtgggcccagcaacccagggttctagtacctggtgactgaccctttctggtaagagaatagtgatgaactttcaagttatctggaggtgagttccgttcttccttgtgagatgactgaggggtgggggctgaaattctgcatggagctggggtggtccttttggtggaggccagacactggcctttgggctccgcaggtgagctgcagcgaaggccctcagtcagccagatggatggtgcgaggagccagggagcccacctgctatgcctgggaaaatggtttgtcttccaggacaagtcattctacaacctgcacagagctccggagctgcagagagggagctcgttgtatccattcgtctgtgtctttatatattcatgaatgtgaatggtatagagtcactgctcaccgtgggataaaaggcaatttttagaaagcatctgttctgtgttctcaacaagactcaggaaactctgtgaaaagagatggagagcgagataactaagtgacagactgggatgaaaatggaattggctgaggagtagcaggaaggaacacgcaggctgggcgaggcgctggggacagcagggaagggaagttccacctgagcaaagctgtgaactcagcttcaagaccccacgctgctgcagaaacctgctggggatggagaggacaaaccccagacaccgtcgtgggatgtagaggggaaggacaaagaacaaaatgaaaaccccccacgatggcaaagacgacgggcaagaacgattgggcgtggcgcgcaggagtggtccccgcgaagacagcgtcagagggaagggaacacatcccagccacagccaggcaggagggagaagcctcggagctgaagcaagccccgagtctgttatcagcaaaggtcaggccaaggcccggggaaaccgtgaaatgttgtgtacacacgttgcacactctcaagaagcttaaaaatactgagtatcataatagcgagcagctatgaggaaaagccactatgagcctactgctggctcaggttccagtcttcgttttaaacgcatgagtgttaaagttaacttctctggccgggtgcggtggctcatgcctgtaatcccagcgctttgggaggccgaggtgggcggatcacctgaggtcaggagtttgaaaccagcctggccaacatggtgaaaccccgtcactaataaaaatac

SEQ ID NO: 916 - DNA, 3059 bp, Homo sapiens
gtcagtttccctcaagatggcggacgaggaggctggaggtactgaggggatggaaatcagcgcggagttaccccagacccctcagcgtctggcatcttggtgggatcagcaagttgatttttatactgctttcttgcatcatttggcacaattggtgccagaaatttactttgctgaaatggacccagacttggaaaagcaggaggaaagtgtacaaatgtcaatattcactccactggaatggtacttatttggagaagatccagatatttgcttagagaaattgaagcacagtggagcatttcagctttgtgggagggttttcaaaagtggagagacaacctattcttgcagggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagaggtaattgtccaagccaggaaaatatttccttcagtgataaaatatgtcgtagaaatgactatatgggaagaggaaaaagaactgcctcctgaactccagataagggagaaaaatgaaagatactattgtgtccttttcaatgatgaacaccattcatatgaccacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattattaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacaggaacaataaattcaacttccagggttatagccaggacaaattgggaagagtatatgcagtaatatgtgacctaaagtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaataatgaaactggcttagagaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattactcatgataaag

SEQ ID NO: 917 - DNA, 3188 bp, Homo sapiens
aggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctagattacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggtcaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagtcatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgattggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttg

SEQ ID NO: 918 - DNA, 2525 bp, Homo sapiens
agtgccctaaagaggtactgggagcggcagcagatacaagatcagtgccctaaagagctactgggatatcagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagctggggacagccacatggtcctgtctccactcctctccttggtgatcacaggtgtctggtgcccttcagggacttgaatccaagctcggaagtcaacaccgcaaacctactcgaatctccttcaagtctcttgctcacttcctgttacatctgtagctacttctctttttacatattaggagaaaagaggtgtcattctttgaaaagactaaggtacagtgtatgttgcaaggtgtgcccaaacttttgtgcatgtggaaaagaaaatgtgtccgggactggtcaggtttgcacgggagtgcacgtaggagccaaggagcaggaggagccaggaggaacccaagcattgaggagctgcgggatctactgcctggaggagaggacggacaaggccagccatgaggagtgcagggagaggagcactttgggaagaccacagtgcacaggactcacacccagccttgctggagaaagcccatgacccaggcttcttccaggcagccccactgtaagacatctcattgcctcttcctgccctgggctgtctgacccactgccccttcccccaggaacacttccactgggatcatgagtcactctgaagccactctgaaatcactctgaagccaaagctgggctcagtggggaaggtcaggaatggagaaattgccttttctcgttagcctcctcttgccctgatttcatcctccctatccctgcacactttcccctggctgctgttgtaatctacttgttctgctgacgcccgaactgacttctttcccggtgtctccccactttctttagatggtcccttccctctttctctccctttccctcctgaatcgattcattttttctctcctgttttatattttccatatctgtgggctttgttctacatttggggagctttttatattgtttatttcatgcttgtactttcccttccaatccttggatcaaatattgattttagagactgtatttttatttcgaaaagtttttttggttctttgattactgatgttttcaaactctcttctgttccttgaactatatccctccactcagtggtcacatctttgttttgttgtctgcttcttctacattatgagccttcctcaagtgtctgctgattcttggttatccaatcatagttgagaacaagataaagtgtagctaactgagacctcagagtatgtaggagtaaatagtatataaaatagctctggtggctcatgcctgtaatccagcactttgggaggccaaggcggacagaccacctgaggtcaggagttcgaaaccagcctggccaacatggagaaaccccatctctactaaaaatacaaaaattagccaggtggtggcacacgcctgtaatcccagctactcaggaggctgaggcaggagaatcgcctgaacctgggaggtggagattgcagtgagcccagattgcaccactgctctctagcctgggcaaaaaaactagttccaaaaaagacacttgtacacgcatgtttatagcagcacaatttgcgattgaaaacatagggaaccagcctaaatgcccatcaagcaatgagtggataaagacaatgcggtgtacatatacaccatggaatactattcagccacaaaaaggaacaaaataatggcattcacagcaacctggatggagttggagatcattattctaagtgaaataactcaggaatggagaaccaaatattgtacatcctcacttataagtgggagctgcgctatgaagatacaaaggcacaagaatgatacaatggattttggggacttaggggaaaggatgcaggggatgagggataaaaaaccatacattgggtacagtgtacactgctccagtgaagggtgcaccaaaatctcagaagtcactgctaaagaccttatccttgtaaccaaaagccgcctgctccccaaaaactattgaaataaaataaaatataaaaagaaagagaaagaaaagaaaatagttccaatttatcatgcc

SEQ ID NO: 919 - DNA, 2855 bp, Homo sapiens
tagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcgtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcgtgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggcc

SEQ ID NO: 920 - DNA, 3512 bp, Homo sapiens
gggtgtggcctccgggcggcatggctgcttctcaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagcagggcacctgttaactggtaccaagaaaaggcccaagtgtttctctggcatctgttggtgtctggatccaccactctactctgtctctggaaacagcccttccacgtctctgcattccctgtcactgcgtcactggccttcagacagagccaaggtgcagggcaacacctctacaaggatctgcagccatttatattgcttaggctactgatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaactcatcagatgcattggacaaaatccggtatgaaagcttgacagatcccagtaaattagactctgggagagagctgcatattaaccttataccgaacaaacaaggtcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaatatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaag

SEQ ID NO: 921 - DNA, 3396 bp, Homo sapiens
cctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccaggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcagattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgatccaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttt

SEQ ID NO: 922 - DNA, 2597 bp, Homo sapiens
attccgcggacgcggttggaggagggaagatcggagttaggggagaggacggcgggaatgggaagccacagttgctccagcacaggagacccctccccatcccaggaaacacggaggactgcagtgaggaagccacgagttcgcagcgcgggttggtcttggccttggctgactcgctgtgtgacctggggcgcggcgcccctccggctcgtggtctggcgaggggagtgcgcgcgtgcgcgtgtgtgttggggaagggggcggactagccttctgggtgctcttcctgccccatggggagcacacccatgcttcaggccccccagccctggtcccgggacccgaggaggccactcacctggcgccagggcgctggggctggggacgcacccagcaggggcggctgcagggtgggcgccctcgggacccccgagtgaggccccgggtgaggccgggaagatgtggagctccgagcggtagttcggcccctcagggccattggcattggcaacctgggcacaggggcgggttctcagaggccaccgacgacctcccgcccccagccgcgctccccttcccccagcttcccttccagggagctcccctccacgctcaccgtccccgactccgctgttccagtcaccttcctcctggcgcttccggccagcatctgggaacgagggggtagaataaaccgcagagaagctcagcggggcaggggaccagggttctccctccaccaaaaaaaaaggtcggggggaggcaagaatcctaacgcccatcatcggggaacaaggatgagttactagtttacaacgctaaacccagtgcctgggaccgagaaatactcgatatatgttaattgctattgtaatgccgagtccgggcaagatacttaatttccctgagcctcaatgtccttctcgatagaatgaggatgatggtgatgaagatctcttcctcagaggggtctatgagcattaaatgagatacctgcaaagtgcttagctagcattgtcttaggcacatagcaaaggcgggtgttttgccatctttatttttctgccacatcactccctctcagttgcctcctgtctagcccagaaattaagtggagggtggatggaatagccctggcttccttagaagtatctggaactgcctgctgcctttctgaagccaagggaaaaacccttcttgcctttcttctccaccagcagattattccatggcctttcctttctccggtgggaagaagaaaaaagggcattctacattttccatcttagatcaggcccaagtctaaactagatccagcctgctgcaaatttagcctagagtgcatgcctgtcttagctttttttttttttttttttggtaggagccagagtcccttcactccacggcttatcctcaaccccctaatccactttgtttactttgttctgtatccagggagagatgcctaaaaagataacacttttcaaggatcacactgaaaggcaggagcctaatctgatgggaacatcacagtcctcagcctggcttaccgtttgactttaggctaaccagtggctctctgtggtcctcattttccccatgagcacaatggtggcttactcaccgcccgctggctggctgctaactcgaaagtgaacttctgcacacggcgctgcctcttctggaagaggagggaccctctgttgttgcgtagtgacagctcctccatcatcaggtcctggggcacgctcagcttcttgcccaggtccagcgtagggactgccaggaaaggccagagcgggctctcaccaccccatcccccatacactccaggccccacctctcgaagcatggcatgctgtgtgtaagaatgcctgtttctcaccaagcttgccgacaccgggtgtcatgattgtttgaaatctttgcccacctgatgggcaaaaatgacacctcagagtttaatttgcatgtgtttgttgctcagtgaagtttagcactgtttccgaagttctttggccatttgtgtttattgcatgaattccccatgcaggtctttgcccataatggtggaggtagtgagaaatggtcagattctcgatattttttaaaggtaagccatgggtatgggcaatgagtgagagaggatgactgcaaggtttctggccttagccactggaaggatagagcagccattcacggagatggggaaggcaaagggaggagaaggttctgggaaagatcaggagttcagttttagacctgtgttcttttaactttaaaatagccttttattattataaaaaagcatatatgggccaggcgcggtggctcacgcctgtaatcccagcactttgggaagccaaagcaggcgcatcacctggggtcaggggttcgagaccagcctgaccaacatggcaaaaacccatctctgctaaaggtagaaaaattagctgggcgtaggtggcgcatgcctgtaatcccagccactctggaggctgaggcaggagaatcacttgagcccgggaggtggaggttgcagtaagccgagattgcattgctgcactccagcctgggtgacagagtgattttccatc

SEQ ID NO: 923 - DNA, 2669 bp, Homo sapiens
aaatatctagagcaaagctgtccaaaggctatcaaaactgaacatgccaactacttgaacgtgtcagaacttcatcccaggaatcttgtaacaaatgttgctcttcctgtgaaatctgaacttcacgaagcagacaagggctttagaatggacactgaagacttccctggccctgagctgcctcctccggctgcagagggagcctctagtgtacaacaaacacagaacgtgaaagcttccacctcaagtcccatggaagaggctatttccttggctaccgatgccctgaagagagtccctggtgcagggagctcaggctgtcgtctgtcctctgtggaggctaacaatccgctggtgacgcagttactacagggcaacctgcctttggaaaaagtgttgccacagcccagattgggagccaagcttgaaatcaacaggcttccattgcctcttcaaactacctcagtgggtaaaacagcaccagagagaaacgttgaaattccgcccagctctccaaatccagatggtaagggctacttggcagggactctggcaccactccaaatgagaaagcgagaaaaccaccccaaaaagagagtagctaggactgtaggagaacacactcaagttaaatgtgaaccaggaaaattgttggtggagccagatgttaaaggggtgccttgtgtcatcagttccggcatcagtcagctaggacacagccagccatttaagcaagaatggctaaacaagcactccatgcagaacagaattgttcacagccctgaggtcaaacagcaaaagcggctgctcccctcgtgtagcttccagcagaacctatttcatgttgacaagaatggcggcttccacactgacgctggtacctcacacagacagcagttttaccaaatgcctgtggctgccaggggccccattcctactgcagctctgttacaggcctcttccaagaccccagtggggtgtaatgcatttgccttcaacaggcatcttgaacagaagggattgggagaggttagtctttcctcagcacctcaccagctaaggttagccaacatgttatcccccaatatgcccatgaaagaaggtgatgaggtgggaggcactgcacacacaatgccaaacaaagcactagtacatccgccgccgccaccgcctccccctccccctccacccttggctttgcccccgcctccccccccaccacctccgctacctccacctctccctaatgcagaagtcccatctgatcaaaaacaacctccagttaccatggaaaccactaagagacttagttggccacagtccacgggcatatgtagcaatataaaatcggaacctctttcttttgaggaaggtttaagcagcagctgtgaactgggcatgaaacaagtttcctatgaccagaatgaaatgaaagaacagttaaaagcattcgcgctaaaaagtgcagatttctcttcctatttgctttctgagccacaaaagccttttacccaattagctgctcagaaaatgcaggtgcagcaacaacagcagctctgtggaaattatccaacaatacactttggtagcacgagtttcaaaagggcagcatctgcaattgaaaagtccattgggattttgggaagtggctccaatcctgccacaggcttgtctggtcagaacgctcagatgcccgttcagaactttgccgacagcagcaatgcagatgaattggaactgaaatgctcttgccggctgaaagccatgattgtgtgcaaaggctgtggggccttctgccatgacgactgcataggtccttcaaaactttgtgtagcatgcctggttgtacgataagagctgagtgaaagatgcagtatcccttttccacacggaaaagccaaatagcatcagcaacaacaaatagaataatgcagtggtttctatcatgctaatttattttgctttggagcaggtacctttcctctatggcattattttcttgcatttctcataaaggggaggatgcatcccaactgaatggctcactggcatgtcttttatgtgttcagttgccattcctagctttggaaagtttctatctgtccatgtgtatacaagtcaatgccccatttttgtttttcttttaaccgaggtgtagataggaaaaggacatttttaattacttaaccggaaatgcagatgtgtaaggagaatgagaggaatgagttaaagtggttatgcatttttctatagatgagccattacagcaaggaattttacagttgacttctctgaacctagctttaccacagtgattaaatcctatttagaaaggggaatctgatttaaatgtgtgattccttgtatttgctcctatcacaaaagatatattaaaggaggtatgccattaatgaaatccactgtcctgagtattatctttcctcctgttgtactttctcagagactatggcagaatatctggatcttccttggattttgtacacatattgtagtgaaatgtgtcctacatctgaaattgcatgggactcatgcccagcaatctggttctaggcctttgacacctgataatatgagagcaattggccagccaatagccataagcccagaggattttagagcttcatgtgtggcttttaagagcaggtttg

SEQ ID NO: 924 - DNA, 3206 bp, Homo sapiens
ccgcagccgccgccattttaagtgatctggaagcgggcggtatcgaggggcgtgcggccgccatcccgacggcgggcatggcctttggaggcggtggcgccgtcttgggactggcagaggggaggtccccgtgttggtgcggtccggcgggctccaagctcgggcacaccgagctcggggccgtcttgtcgcggcgtagtcgtggccgccatcttgggcaggctccgcatttggggtcttctggccgccgtgctggggacagtcacccccgctccctgacccgggctggatgcgaggactgtcgccgctcagaggggcttatgacctgtgaagagccctgggggctgctgttgggcttagggatggcccgggcgaactccttgggctagaagaggaggcacgggagcggttggcgaccgctcttcgcaggaggagggaaggggcagctccttgccccaggagccctgggcgcctgtccgccttcctgcttggctgcatttcggctctgaaaaggcctagagacttgattctcctggctggccgctctttccaccaaggccctgtttcctgaatgctggacactatcctgcatcgccccaagttgcatttacatgagagtgagggccccccacttgacctctcccttgcagagacaccccaggctgggtcgtgctgggcgggtgtcggaggcggcgttggagagatgagccagagggtggccctggacgccaaaccgccctgcagtcctccgagctgcgctttgagggctgttgagagaggggtggaacgtggaggtgcgattgctgcctcggcatctagagaggcgaaggagcagccctgggctccgctgctgactgtggccatgggccgttaacctcatcaaagcccagtttcctcctgttgtagatgggagaggaacagtttttgaactgcgtagaacctcggcaagtcttagcgctgcatttgtgttttctaagctgtaattctagttattgctacttttgacttgtggaatgtggctcctccctggggagtcctccaaagtcccttccctcgtgtgacttccttcactgcggttcactgcagcccctacccccgctcccagggtcctcagcatcgcagtccctgcagaacctgtctcttcttcatgacgtgagtcatgaggcattggacaggtaattgctgggaagagctcttggccaggctaaaatttctttctcagtcgcagtgtctggctgggggcggtggctcacgcctgtaatcccagcactttgggaggctgaagggggtggatcacttgagcccagaagttcaagaccagcttggccaacaaggtgaaaccctgtctgtactaaaaatacaaacaaaattaggtgggcacggtggcgcacgcctgtggtcccagctgctcgagaggctgagccaggaggattgcttgaacccggaggcgcaggttgcagtgcgccgagatcgcgccactgcacatcgcctggcgacagagtgagactctgtctccaattaattaatcccagtgtctttacctacatagaactggcaactttaaatcctgtgcttctgtggagggagagcgaaggaagagtgtggacagtgggggccaggaagttctcaggtagcccagcaggccacgcagaagtcaaggggtgtgtaggtacaggaggggccgtctccacagggagacgcctggatccatactccatccaggcttcatctgcagagaccaggggtggacacctcgtttgtgggggccgtcacagctgatgccccagctcaggatgtccaccagaaaccaggagtcaccatcctcttaagggtggtgcctgtcctccagagagcatatcactgggttcaaaccccagctcctaccggcaaagcccggggcctccacctgggtgttcccatccatgaagcggggatacacagtgtggagcccttgggaggttggggagtgtgcctgccctcaccgcgcatcagctcataaatacaacaacagttgccttcacgtgctgatgctcagtgagcagtggcgcagttccccagctggcgcagtcagtggtgtctgtctgctgtcagaggtcacctggacccagcacgagtccttgcccctagagggagtctccacacaccccacgacgctgtcctccctgtgggataactacacgaggagatggcaggccatcgtatcattcagtgcagcgatacctcctgtggtgggaatggggtcaggagggattttcccggagcagggccactcgctggcctagcctggggtctccacttttggaagtgtggtcttgtggggtccaggttctccttaagggcctttacaaggaatgggagcgtccagtggtggagaggagctggctggctgcgcctgctacccacacgggaatgtcctcctgggctcctctcttcaactggccctcacctctccgcctcacggatttcactcggagaatccgccttgcagcctgtcttctgctccctcccatctaccttttgtttttttttgagacggagtcttaccctgtctcccaggctggagtgcaatggcgtgatcttggctcactgcagcctctgcctcctggattctcctgcctcagcctcccgagtatctgggattacaggcgtgcaccaccatgcctggctgtttttttgtatatttagtagagacggggtttcaccacgttggctaggctggtctcgaacccctgagcttgtgatccacctgcctcagcctcccaaaatgctgagattacaggcgtgagccaccacgcccagcgtctgtctaccttttattcccatcactccccaccccagacagggtgttgtgttatgatggggaaggcccttgtgtcttttgggtgtgttagacctgggaaacaatctgtcttctcctttcacgtgccccaaagcaggactccaatcttccccgggcctttctgattgggagtcttaagaccctccccagagagggccccaccctgttccctgggaaaggcatgctgacaaaaccctacaggacggtttggagacagggttagttcaactcgtgtgtgtccccagagggtgacaccacagggatgaatgggagttccaggcccctccccagcacctcaacctgcacattgcttcatctggatcctttgtaacatcctttatgataaaccagtgaaggtgtttctctg

SEQ ID NO: 925 - DNA, 3130 bp, Homo sapiens
attggcgtttttttggtcttacgccctagggtggggagaggactccggtgcctccgggtctgggctgggccgcaaagggcggggcctgggcccggcgcgggccgggagcagaggccgagaccctgcaggtgattcctggggctgccagctaaggtcccttatgatttctgctctggctttgcagttttcagcctttcccaagagcagcagaaaatgaacaagttccagggacccgtgacattaaaggatgttattgtggaattcaccaaggaagaatggaagttactgacccctgctcagaggactctgtataaggatgtgatgctggaaaactatagtcaccttgtctcagtgggttaccatgtgaataagccaaatgcagtcttcaagttgaagcaaggaaaagagccatggatattagaagtagaatttccacatcggggcttccctgaagacctatggagcattcatgatctagaagcaagataccaggaaagccaagctggaaattcaaggaatggagaactcacaaaacatcagaaaactcataccacagagaaagcctgtgaatgtaaggaatgtgggaagttcttctgccagaagtctgccctcatagtacatcagcatactcactcaaagggcaaatcctatgactgtgataaatgtgggaaatctttctctaaaaatgaagacctcataagacatcagaaaattcacacgagagataaaacctatgagtgtaaagaatgtaagaaaatattttaccacctatcatctctcagtagacatctgagaacccatgcaggagagaaaccctatgaatgtaatcagtgtgaaaaatccttctaccagaaaccacatctcacagaacatcagaaaacacacacaggggagaaaccttttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccctataaatgtaaggaatgtgggaaattcttctctaggaattcacacctcaaaactcatcagagaagtcacacaggagagaaaccctatgaatgtaaggaatgtaggaaatgcttctaccagaagtcagccctcacagtacatcagcgaactcacacaggggagaaaccctttgaatgtaataaatgtgggaaaacattttactataaatcagacctcactaaacatcagagaaaacacacaggggagaagccctatgaatgcacagaatgtggcaaatcttttgctgtgaattcagtcctcagattacatcaaaggactcacacaggagagaagccctatgcatgcaaggaatgtgggaagtccttttctcagaagtcacattttattatacatcagagaaaacacacaggggagaagccctatgagtgtcaggagtgtggggaaacctttatccagaagtcacaactcactgcacatcagaagacacacacaaagaagaggaatgctgagaagtaagatgagttgggaaattctcttgactgaattaatccttcaaaacaatcagataattcacacaagaggtacaccttatgaatcgcatcaatagagggaaattttcagctacaatctttgctctctctgtgtatcagcaaatacatagagagattctgtacatttatttgggagaaaattttatcatattttaggcttttctaaatattagataatatagatggcagaagtcatgcaaattgtaaaacaggaaggaaacctttcagaagtcatacttttgttttgcaacatagaagtcacacaggagaaaaatcctgtaagtaaaacgaatgtcaagacattttctgtcagggcagccagctgtagacatccaaaagctcacaaatgagaagctccttgagtatctagaaatctctttacacaattggagctcatgtactagagaattcaaagggataactgcaaagacactggtagatatagaagcctttattaagaattgatgtttcattcaatttcagatcactggtacttggatagatattttaaatatttggaaggtgttcaataaaaattcaaataatttgtactgagggaaacagttatactacaaatcatgttgcagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaattataaggcatctttttatccttttttgtgtttgtaaatggatatagacagtggtaataactaatccttcaaaaataagttaaaatgtttttgtaaaattttcaaatgtcagtcaagttttgcattagggacacatttatatatagcaaaagcctgagctgtttttaaacagctaaaaacagtagtatttattacaatctccacaatgaaaacaaatagtgcaatgtaagaaatattatgtatcttactgttgatgtgtgatcagggagcagagctatctgcatttgtatttagtgtgagagtcctaaatgttcttcaccaactttttcttcctcatagaagcaacatggcatagttaagggtgtggactctgggctcctgctgcctgggccccgattccagcatggggcatgctacttaatatctctgtgcctcagttcccatcccataaaagagtagtgatagtgacaacatcttaggattgctttgaggtctaaatgagttaacattttcaaatcacttagaatagtgtctgagacacaagagctatatgttagaggttatcatcattatttgtattttgtgaattacgctgc

SEQ ID NO: 926 - DNA, 3548 bp, Homo sapiens
atgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtaatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggtctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttgcagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaacaaagtgttttataatacttc

SEQ ID NO: 927 - DNA, 3458 bp, Homo sapiens
tttagaaaagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtgactcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttgacgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctacc

SEQ ID NO: 928 - DNA, 2897 bp, Homo sapiens
tgcccaaggcccacccgtctatttccacctcattccccctttaagctgagaatggggtctgcctatagaagcttccagagacagccgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgaggagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagccccccaacccctcccctcccctcccctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagccagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacctatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagctaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaac

SEQ ID NO: 929 - DNA, 3905 bp, Homo sapiens
aaagagcccgctccgccgagcgccgggcgacggcaggaagcccctccgcttggccagaatggagcagccgaagggagttgattggacagtcatcatcctgacctgccagtacatgacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgctcggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccccgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgccgtccgcgagggctgccccgggcccctgctggccacgctggaccaggttgcagctggggcaggagaccctggtgtggcggcacgggcactggcccgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatccctgagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgc

SEQ ID NO: 930 - DNA, 3365 bp, Homo sapiens
ggcttagtgggggaggggagagaaagcaagaaagactgctctcggcacttgtgcttttgttagttctacagaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcaattccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggactaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagaggaagttcctgttaacattggaagagctggtgcatgtgttgtagtggtgaggctaccctaaagctatctatctttatcaaatggaatgaaactagataatttcaagaaactgagtaggacaaagggagaaagaaatacatgttctttttcctgcaattaataatcagactggaaaattgttgtatcattttaatttgtagttacaattgctttcattcgtgaagccgaaacgtttttaaacatgaattacatatgaattattaagcatatgtgctttcgcagctgataatataaaaggaaatcccacagtctagatatagccccattactacaaaatgctaaaatatttaatgaaaattgatggtggccacagtgtgcaggttataaaagcattaatacatttcaaggtaagagccttaaaagttaaaaacattttcagtttttttttaaaaaacgtactcttattatctggaacatagaaatataaaaggtaacatctaaagcttagaatagtgtgatttttagtaagccattattctcctattcaaataatatcccaaagagctaaacaattccttacatttaccaagaggaaagcttttactgtgttgaggctaaaaaaaataatggctctttgacaaaacttgttatgttgatcgcggtatgtcaaaatttttacaggtttgctcatctgccagagcacacatataaatttggtatttcttaacatattatcttgttagatttgttaccagtaaaatattactgtaatttcatatacacagtctatacaatgaaataatgaatatttatcatattgatacaaactgtgacctcagcttcagagtgtcagggcctcacttgtatagaatgtaatgttctcctcaaacatttatgttaactctataaacaaatatcgttaagttaaacaagttttcaaaaacaaaacaatttttaaagtaccttaaaattgaggatgttactcagtgttaacacatgggaacaccaaaatattcaataagcctggtcaattctatagttatcttttttgtaccaacacatgcttttctgttactgttatattatccagtagaaaatgttaggatatgtgtgctatat

SEQ ID NO: 931 - DNA, 3762 bp, Homo sapiens
cttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactcttccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgattt

SEQ ID NO: 932 - DNA, 3180 bp, Homo sapiens
ctctgactggggcgtccgactggagctcagccgcgcttgtccggtgctaggtcatcctgccaaacacccgaggccccaaagatggtgcaaagtgaacttcagctacagcccagagcaggcggacgagctgaagctgcaagctggggagatcgtggaaatgataaaggagattgaggacggctggtggctggggaagaggaacgggcagctgggagccttcccatccaactttgtggaattgctggacagtgggcccccaagccttggtaacccagacatgccttcagtcagccctggtccccagcggcctcccaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacgaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggagggggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaaacacgtcctatcaagccgcctccagactcccaagagacgctcgcgctcccctcgctggtcccgcaaaactacacggaaaacaagaatgaaggagttgatgtaacgtcgctgaggggcgaggtggggtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaatgtatgaacccagggcactgtggggacagggcgacgtgtgtccaggcgtttgccggtccggctgcccggtgcgccagatctcccgcaggatccgttcgcgctcctccagccgctgcgcccgctccagctcctccgccgacgtgaagacgttgacgttgaggggcccgtccggctctgcggacagctcggggcccggcagcgtgtcgtcggggcccagccgagtcaccgtgtcctcctcgtcctcgtcgtcgtcctcgggctccagggtgctgctgcgggggtcccggcgctgagccgggccccggggccgcgggcggggcgcccacgagatgctgatgacgagcaggcagaggatcaagtaaacggagtcttggagagattgaattgactttaccaaaaccgtcaggatttgaatctgctgctctctgatcctaaagcctgagctagaaaccaccgctccccctcctaggaggccccttccaggcaaagctgcttctcttccccagacccatgctggactggaagggaggggactgtccacccctccttccagggcccaggcttgaatgtgtcccctggccgagctctggtctagtcacgcagggttaatgattgttggactccagctttgagccagggcccggccagcagtctcgcagaccccagcgtggggcctctgtgcctgcgagctcctgcgctcttgtgcaccaagcagcttgtggcggcttgtggcagatcccaccccatcccgtcccccaccccaaggctaaacctgcctgtgctcacacacgcatttcccacctgggcttgtgcatgcaatgtggtgtgtgatcagtgtgtgtggcggggggcttccttctgccctgtctccacggggcccccccatcatggacctcccctcccttgctggagctagaatgagggggaggccgccttggcgggagccttagagaggaggaggaaagggggagaggaaattgcagacatagctgaaggcgctgcctgaggcctgtgggccagcgaccctctccctgtccgggctgcagacccctactcccccagtcccgagactgggttcaagtagagggcagatctagatgggggaggactaggactgactcctatggggatggaaaagggactcctgggtgtctttgtgactgtttagtgtgttctgtgaatgtgcgggcaggtatttttgcccacatctgtatatttgtctattaatgtgatgtatttgagtattgttgtgggggcgggtatgtctgtatataaatctgtgcagccactagtcaac

SEQ ID NO: 933 - DNA, 2440 bp, Homo sapiens
ttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtgtcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcaacaggtgtgccctggggctatgaagagaccaagacgctcctggctattcttagtagttctcaattttatggaaaactccagacctgtcagcagaacagccagatctacagggccatggcggaaggactctggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccacc

SEQ ID NO: 934 - DNA, 3033 bp, Homo sapiens
ctcctatacagggctcttggttcaggtctcttggttcgtcctgctgcaagttgggaagaaagataataggaatgctaattccttcttgatgaaacgaccacaacacgctggagccggccttggaccctacgtttcaagattggcctgcttccagcgtctgccagctccactgcacaagctgcggcagccgctgtccccgttcgcttccacgggagtcccagcaagactatgcgacccagttcaaataccatcttccatgtaccgttcgtgaaatcagcagcttttgacattcaagagaggacagattacttaaaaacagactcatgaacaaatagggaaacgaatacatcatccctgtatcgaattcatccctgtataatcctgcccttacacctgtgctcctatacaagattaacattcaaaaagagtctccatggtgcccagctcgtctcgaactcctgggttcaagcaatcctcccaccacctccgcctcccaaagtgctgggattacagggatgactttgggaaattgctgctggctgaggccctcctggagcagtgtttgaaggagaaccatgccaaaataaacgactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctgggacagatctggctgcaggctgctgagctgttcatggaacagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcc

SEQ ID NO: 935 - DNA, 2770 bp, Homo sapiens
gtgcttgcggcaaccctgtaaccgccggtgcgcaagttggaggggcaaggggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccaggggcccccaaacccggggccgcagagcagtaccagtccgtggcctgttaggaaccaggctacagagcaggagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctag

SEQ ID NO: 936 - DNA, 3327 bp, Homo sapiens
gcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcccggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctacctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtcctggaagcccaagtgtggactcctcttctgtgatgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggtaagctacttagcctaggccttcccttctgtgtactctttgcatgttctcgacatgtttgtgctggtttcttggacctcttggccatgtcatttctgtgtacttgcctagcccctcatccatcctgcttgcatcacttccagatacgtgtcatgtcatacttgtgtccctgtgtctgtctgtacgtcttccatgcttgtgctggtttgagtattgacttacatctgagccttgtatgtatgtcctatgtgcatgttcctcctctttccctagtctggccatttcctgcgatttgtaattaggatattctgtgtttgatgtttcctggtgaatcacagcaatatttctgaaccatattgaagacgtatgtgctgtcctgtatggagaggcacctaaacactctctatgccattccgtccagtttatctgtctgggtcttgggttttctgtcagctctcctggggcctaaggttaaccttccggtatttttctccctactcagctccttcctccccacctcttcaaagaaggacttgatttcaagtttttcctgttcgctttccttgtaccttcttggttgctgtgactgtctgctagcactaagactgtcttaagcagatagagtgcaatttctttgaaggcaaatgacaaagcgtggccctgagctccctgactgagttcatttggactctcaaggatgccctggagctagactcgatctgagtggttggactaactcctctttgtttttgtatgagagccagcttaccccgccattctaaacctcaggtcaggaaaacc

SEQ ID NO: 937 - DNA, 3251 bp, Homo sapiens
gttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgtgggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaagtcagacagcctggagaagatcgagaggcgcgtccaagcactgaacaccgtcaaccagagcaagaaggccacgccccccatcccctccaaacctcccgggggctttggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatccccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaac

SEQ ID NO: 938 - DNA, 3154 bp, Homo sapiens
atctccaaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcgcagcaaaacggccaattgcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaaaagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcac

SEQ ID NO: 939 - DNA, 2750 bp, Homo sapiens
gttttaaaaagaaacagaaacatacacagggggttggtgaatggtgccgaccgcggccatcgcagttggaggctattttttgggggggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattct

SEQ ID NO: 940 - DNA, 3260 bp, Homo sapiens
agacgctgtgaagagaggagccgcggcggtcagtaccttcgaggaaatgaaggaaccagatgatcaggatactgatggggagaaatcagttacatcaaagagtgatgggaagaagtctctgaggtcttctaaatcagaatcaagatctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacagtacctcagcaaacccctgctccagctgtggaagaagcagaggaggaagttaagaagaaaatatcagagagcttcttctatgattatatggagcttgcttcgatgccttttgtgactctggattcaaacataccactggatcttctcacacttgtacattcttttggttatgactgtagaaagcgagccaacctacaacttctggacgacagtatcgccatatacatagctgggaaccaactaatctttctgaatttgaaaaccaaggaacagatctacctgcgaagtagcagtggtgaaggaattggcgtcattggggttcatccacataaaacttatttcacagtagctgaaaaagggagttttccagatattatcatctatgaatatccttctctgagaccatacagagtccttcgagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagttctgggaaatggcttttacgttcaccggtctcaagctgcagggatcactaggtcgatttggcaaaacaatcactactgatatagaaggctacatggagctcccagatgggaaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttaggatatgggattttgagacaatagacactgctgatgtaatagatgagactggattgttggagattgagcctattaatgaacttcaagtagacaagaatgtgaatctcttctctatgataaaaatgaatgaaactggaaataacttttggttggctcaggatgccaatggagccatatggaagcttgaccttagtttttcaaatattacccaggacccagaatgcctcttctccttccattctggagctattgaagccgtggctgtttctcctctcacttatctcatggccacaactgccttggactgctctgttcgaatctatgattttgctagcaaaactcctttggcccagatgaaattcaaacaaggaggtactgcccttgtttgggtaccccgaatggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacagggagtaaagatcaaactgttttcttctttgaagtggaaagggattataagccgattggttatattaatactcctggacctgtgtgtcagttaatgtggtctcccatgtctcatcctgaaagtactttactaattatctgtgaaaatggctatattcttgaagctccacttccaaccataaagcaagaagaggatgatcatgatgtagtctcctatgaaatcaaagacatgtgcataaaatgtttccatttttcaagtgtcaaatctaagattctgagattaatagaaattgaaaagagggagagacaaagggagttgaaggagaaaataagggaagaaaggaggaacaagctagcagcagagatgggagaagatggagaaaaagaatttcaggaggaggaagaggagaaagaggaggaggaggaggaagaagagccattacctgaaatatttattccgtcaaccccctctcccatcctctgtggattttactcagagccagggaagttctgggtttctttgggtggctatgattctggttttctatatcactgtgagttccccccttgtgatgaaagcagtgatttcaaagaacaaaaagatgaacctattgatgtccgttatcttgcggatacagaggacaatcccatccaaactatcactttcaacattaacaaagttatgatgttttgtggaatgaaaaatggagcaattcgagtctatgtcctaaatcaaaatgatccttcattgaccagtttggtggactactggcacttcaatatgcatgacaataattatggatgtattaaaagtattgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagtaagcctaatataaacttgatttttattttaacatatgctatttctggatagagatgactattttcccaacaagtagaaacacttaaaatcatctttcttttttgtttgttcctttcaaaatttcaatagccatttattttgggcatcttttaatttgtatgtggggtttatcccttttaatcagttaagattcttgttgacacaaattgttttacatcaactgttgttatagaacacatgaaaggaatacatggggaagaaataaagtagaacccaag

SEQ ID NO: 941 - DNA, 2719 bp, Homo sapiens
gcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaggaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcagaatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagccttttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttttaattacagagaaataagttacaccttagtatcagatattaattttcttcagtgttcaggcaattaatatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttctaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttct

SEQ ID NO: 942 - DNA, 3033 bp, Homo sapiens
aagttaccgcactaccttctacataaagaacaagcatgtggatggtgtgtactcctctcaggggtgtgtaacactcaacagaaacaatcaggggctaactacagaggataaagaagagatggcatcgcttacgccattggggattataggagctgcgtgtgtggcaggcaggagcaagagcccacagggtggtcccaggatgcatgggggtggcactgagctaggcagaggagccacagctgagtgtgtgcttcaccattccaaagctctaagaccattgatcggtaaaatccaagctctctcagctgaagccagcctcaaggagacatctggtttaggcccctaccttctaatggctcaaataccattatctctattcattttacagtgagtgatggaggaggaactagaacccaggtctcctgactcagggaagggctgaattaaggatcactggaagacaggtggccatttttctcagggccctccactagagtcagtgggtcaaagatggacttccatgaattgctgacaaatttttctgtgtacatgtagatgtaacatttctggagagagggcactttagatttaataagatactgaaataggtccaaaacccagaaaggtcaagaactactgcattaaagggtgcgggaatcatacagctgcaggattcgagactacagctgggagttgccaagggaaacagagccacccacaacaatttgagggtctgccagcgaggtttagatcgaagaacattcaccatctctacacctaaatggagcccagatttatgtatatagacatttcctttaacatagggaaaatgaagtgaattcccagtgttttcatttgcaaagcaaagcctcctatgtcggctcttaaccttcaagctttcagcccatcaaaacctccaagctttctggaatttcactgcaatcccccgtatcatccatgggtctctggctcctgagagccacattagagctcactcaaccagtcaacaacacctgtcccaccaccacgtgcccagcgaaggcagtggattcagccaagtgccatgagaaacctaatctaaagctcttctcttctttaatcttgggtagattagaatcacccatcctgttccattgctcttttatgcctctgccccaattcctcaacctctctgaccctaccatgcacacatgcaaatacatgggctgtgttcacacatgcatgtacatgtgcttgcacaaacacacacaactttgtaaatgtcaggtgcagctctactccagtcctccattctacacacaccatctgccagaagctattttcagcacctaataaaactgttttagagtgaatcctggggtgttctgccctttgcttccccagggcaagagcaactgagctccagatggagctaaattttgctaccaagtgaagaggaggagaaagagtcaaccaagggctatcaagagaccctagtgacctccccacaagcagtatggtgtgtctcagctttgtacttactgtcccttactataacatccttgggctagtaaccaaacctccccacctcacccataggtggctactaccttactcagtggttctcaaacctgagcacacatcagaatcacctggaggggtggcaaaatcacaggttgctgggcctcatctcagagtttccaattccctaagtctggagtggggcttggaaatttgcatttctaacacaagttcccaagtgattgctggtccagggactacaccaagagctagtgacgtaactcatgagcttgttgtgaagattaaatgagaaaacatgcaaagcacctggcacatagtaaggtagtgggtctcaaccttggctgtgcattagaatcacctggggagctttaaaaaaaccagatgctcagcactgcagaccaattaaatccaggtctctaggggtgagatacgtacattaccaccttttaaaaagctcccaggtgacttacatatgcagccaaggttgagagtcactgaattaagtgctcaataaatttacaacgccctttataagctacccagccacccccatcctaacagcctccctctcctcctccttccccagggtcccatctctcactctggctcccatgggaagacctgagtgaagcctaaccttggctttggcttctagagtggatgctgaggaccacgtggaagatgaactccagttcattcactcagtggctcatccactcaggcgctccttcactcagtcatcatcaacccagctgcctttacggcacccacgaggtgctcgggggatgcagggatgagtcaaatccagtgctgtcctcaggagttggtaacaaagaacaaaagatgtagaataatagactctcagattccgaagggtcctccagccccacctcccacccaccacagaagttgtctttacaacctccccatcatctcttcccagcatcaatactttaagtgacagaaagcacatcacttcacaaggcagcccgtccagcttaacaatgctacttgttagaaagttcttccttagacaactgaaacccactgccctgtaacccccactcgttagctctaaactctggaagctcctcatcccaggcttggcctcccacacgactagactgcagctatccaaattccttccatggtaaggagaaaatacagccgaaaaatcaagggtgcgttaatcccgtcaaagtacagaggtcctctctatgaaaattgactgccacgcatggtggctcacgcctgtaatcccagcactttgggacaccaaggtgggtggatcacctgaggtcagaagttcaagactagcctggtcaacatggtgaaaccctgtctctgctaaaaatacaaaaattagccaggcatggtggtgagcccctgtaatcccagctacttgggaggctgaggcaggagaatcgcttgaacccaggaggcagagtttgcagtgagccaagatcgagccattgcactccagcctgggcaacaagagtgaaactctgtctc

SEQ ID NO: 943 - DNA, 2964 bp, Homo sapiens
atcttgaataggaggaacgctgttgctgtaatatgcgtagcttgtgtgtgctcttgtgtagtctgtgtgtgatcaaagggcacggaagtggctgcactttcacatcccttttctttacttagctggaaccttacataccagtacatgctcctctgtaagcagctgaactcaccggccacttctctgtttgcctatagacaaagactgtgtgtgtgtgtgtgtgtgtgtatgtatgtgtgtgtgtggtgcacacattgtgttcttaaactgagacgtggctctgcaggtctcctgggctcattccatggtgtggtatgtttattccactgtccagagctattctctgatggatttgagcaacagcagtggagataaatgtcctagagtcaccaggtcgcttggagaagtcatttaagctgcctcgggtttttgttacttaaaatgtggatattatttctccacctaaatcactgagtttacagagtaataatgtgttgctctggacattgacagctttctagagccagtaatgggctcttctgaaggatgctgaattagaagtgaacctattcataggatcaaaagccacttgctttgaaatatgtagagttcctcagaattgacggtgctagaaatatccaagtgttaaataaccctttaaaagcaacaaaagctacttttttcttaccacttaatagaagaacctgtccctagaggcgacttcattgctatggatctggagtctctgaactcttaataggatgcagcctcacatacataatgtcacccattttatgttgatgaaaacattacaagttttcatcattgggtatgtgttgatgttcacagacagtacttgggcccattaggttttcgcgtctggtcttagagcatgtgtattcatctcagcgtgaatacctcagccagtcttatgaataggaggctatgtatgggcagggaatagattagattagaacactcgcacaagatgaccacatatagaagcagaaagccccaaattccctgggaactgttttttctctagtagctgaatataaggaaatatgtctaatggacaccagttaatactttttaaaactactctttaaaaaaaaaatacgttccccttggttaactgattttttaatccagggtggacattttttcaacctttattaaaaagacaaataaactattttgtagaagatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttacgtgaataaatgaatgcttgcc

SEQ ID NO: 944 - DNA, 3958 bp, Homo sapiens
ttttcaagaggctgcagctgacaagaagcttcaagcataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcgactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctataagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattc

SEQ ID NO: 945 - DNA, 4001 bp, Homo sapiens
aggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgatgtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccaattgagaaacactaaggttatggtgaataaaaccatagggagctttttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacacggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagatcaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcag

SEQ ID NO: 946 - DNA, 3374 bp, Homo sapiens
gcgacttccggcggcgccgaggcacgcgcgccataagttggagctcccggggcgcccgggacgagcttcccaggattccccgaccttcccgtgctgctcggccttggccgaagcatgcgcggctccggggtcccctcgccgagaatcggggtcccccccaccgtccaaatcgccccgcctcagggacccgcctcagccttggcgaggccgcgccctggccgtgtgagcccatatcccactctcacggcagtccccagagtgagggtcccttccacaacggagaaagacgtccctttcgcaaaagcgacttggtcgggtccccagacccttgccctccactcccagacgtcacagacaggcctcgctcccttctcaggggccccacctgactgaggcttggctggacacaatcctgaagcatgcagattccagacatgacccccagcagaaacacacatcactgtttcaaacctttggcgtgtcattcgtgaagggatgagatggcagctattcagtcatagtactccaagggtccccggctctaccctccagttattctaactcaacgatttgccaaaaccacctgtcgctcccaagccaaagactaccagtccactgacgccagtgaccgcacccaaattcccttcctcagccaggctcgagagtcttcacagtccaaactccatgttcacgggtctgaagcccccccattgcccccaagcccaggctgactgccccaaacgagtggagagccagtgtgtacctgaatgacagcttgaacaaatgcagcaacggacggctgctctgtgtagacagggggcttgatgaggggccccggtccgtcccaaagtgctctgagtcagagaccgacgaggattacatcgtcctcagggctccgctgagggaggacgaacccaaggacgggggcagtgtggggaatgcagccctggtgtctcccgaggcctctgcagaagaggaagaggagcgtgaggagggaggcgaggcatgtggcctggagaggacaggagctggtaaggactcggcggctattgctgccccagctgcagtattgctgagcagggagggtgaagaaggcacagacctcactcctgaggaccaaggagagggctgcggatgagccagggacagaagagcaggtgtccagaagtgaggaggaagagaagctggtgcagccacacagggagtgcagcctggacaatggcaggccttgggctggagaggtggtcttccagagcgacctcctcctgcctcacatccatggagaggaccacaagccccccgacaaccctggggaggcagaggaggatgatgaggaaggctgtgccaggacagacccagcggggcacatgagggttcggatcctgacaggcccactgaggacatgggagaggatgctgaggaagccagcgaggaggcccctgagaaggaggaactggccggggtccggaggcagagacggccatgaacagccctgaggttcttgaggagggatgtgaagaggccacaggtgtcataggtggggagcaggttgaccttggtgaactacctgaccatgaggagaaaagcaaccagaaagtggcagctgccaccctggaggaccgcacacaggatgagcctgctgaggagagctgccagatcgtccttttccagaacaactgcatggacaactttgtgacttccctcacaggaagcccctacgagttcttcccaaccaagagcacctctttttgcagggagagctgttctcctttttctgagtcagtgaaaagcttagaatcagagcaggcaccaaagttggggctgtgtgcggaggaggaccccgtggttggggctttgtgtggccagcatggacccttgcaagatggagtggcggagggtcccacagcccctgatgtggtggtcctgccgaaggaggaggagaaggaggaggtcattgtggatgacatgctggccaacccctatgtgatgggagtgggcctgctgggaggatgagggggaggaggaggaggaggagttcgtggatgacacactggccaacccctatgtgatgggagtgggcctgccaggaagaggaggggaggaggaggaggaggaggaggtcgtggatgacacgctggccagcctctatgtgatgggagtgggcctgctgggaggaggagggggaagaggaggaggaggctgtggatgacacactggccaacccctatgtgatgggagtgggactgccaggaggaggagaggaggaggggaggagaaggaggaggaagccatggataacatgctggccagcctctatgtgatgggagtgagcctcccggggggaggagggggaagaggaggaggaggttgttgatgacacactggccaacccctatgtgatgggagtgggcctgccggtctggcagccccttgagaaggagggcaggctgcattggatgccctgggtggttatggctcagaagaagaaatgaactgtgaaggagagggcagcctggtctccgtggacaggaagaacatcgacacaagggcctggccccactctgggaaggtggccagaaaccgtcccagaaactgcccccaaagaaaccagatctgaggcaggttcctcagcccctggcatcggaggtgccgcagaggaggcaggaaagagctgttgtcactgaagggaggcccctggaagccagcagggccttgccagcaaagcccagggccttcactttataccctcggtcgttctccgtggaaggccaagagattcctgtttccatctctgtgtactgggagccagaagggtcggggttagatgaccacaggataaagaggaaagaggaacatctctctgtcgtgtctgggagtttctcccagagaaaccaccttccatccagcggcacctccacgccttcttccatggtcgacatcccacctcctttcgacctggcctgcatcaccaagaagcccatcacaaagagctctccctctctcctgatcgacagcgactccccggacaagtacaagaagaagaagtcatcctttaagcggttcctggcgctgatgtttaacaagatggagaggccaggcacgatggctcatgcctgtcatcccagcactttgggaagctgaggcgagcagatcaccgaaggtcaggagttcgagagcagcctggtcaacatagtgaaaccccgtctctaataaaaatacaaaaattagccaggcatggtggtgtgcacctgtaatcccagctacttgggaggctgaaacaggagaattgcttgaacctgggaggcggaggttgcagtgagccgagattgtgccattgcactccagcctgggcaacaagagtgagactccatctc

SEQ ID NO: 947 - DNA, 3145 bp, Homo sapiens
tataatcccagcactttggaaggcggaggcgggcggatcacgagttcaggagatcgagaccatcctggctaacatggtgaaacccagtctctactaaaaatacaaaaaaattagccggacttggtggcaggcacctgtaatcccagctactcgggaggctgaggcagcagaatggcttgaacccgggaggcggagcttgcagtgagccgagatcgcaccactgtactccagcctgggcgacacagtgagactctgtctcagaaaaaaaaaaagaaaaaagtacgaatgtaaacgtaccaataggtgctcatactttacaaccaggcagaggacatgcaaaataaaggtaactgtagaagcttagggaacactgtatgtgtaattccaatgaacatgttcagaagtcaacagagtctagaagtatgtaatgagaagtgttggcaatatctgaaaattggcctgaattgtaattacattttctctttatcagttttaatgtctttgtctctgttaaatacttggtaagctagaatcaacatacttatttggagggaaaatggtataaggagttgatgcattagggcttaaacagccattaaatacttggttacaattacaaataaattttcaacagtttaacactgttaaatactttgatgaatagaaaaatataccaaattctggtcacaagtagtgtgtgctaagtactctctataaaaatacactatattagtcacagtataaaaataatatctccccacacacccgtctcacctgtatgagttcttacatgcgttttcagctggttacattgggtaaatgcctttccacataagtggcagacgtaaggtttgactcctttatgtattctcatgtgccttctcaaactgctggcttctgaaaacactttcccacatgtgttacacattggcttggccttggaatacctctgatccagctcttccccggagttctccgcctcataaggactcttgacgctggctatattagacatagagtgttctttcagagcacagtttggctgtgattttccacgtttccgtttcactgtaacagtgtgcacaatatcttgtgctggaaaagtattttccacaactgatgtcaactcgagttctgaattatcatttatttgtgcaacttgttctactacaggtgtgggcagtttatttgcatctaggaataattcaacagatgcattctctaagatgtcactgggatattgcactgttttattctgccctgttttcggggagttgaaagccttcttcttctttttcgtttgagatgactttttcgctaacgcgccttgtttaggatttgcctgaatcaaatctgtagatacttctgatttctctcgattattataatctcgcagagtaagaagacaagtctgttgattcaattcaatgtttccagtaatactagatatctctgtagaagaaggattagcaataaaagcaaaatcttccatctttattttgcatttagtgaccacctcttccactttgagatagtcagcagcctgatgaatttctttaacattccaactgcaaggaaacaaggctacatgacaatattctgatcaaagaaaaactttcgaaacagagctgcatatatacttcaatgtattttaaagacctaatgaagcagaatgctgaaaaagacataactaagagaaaaatagatttataaattcattcagaataatgtttaggtaaaaaatctccaattttacagaacttcaagagatgaaagataatggctattcacagctgacagtgaaccactgcagaaaaattaaatgttaaattttctggctcttttttttaaaaccctagaacacaaaaatagctgatggtaactcactacctcctccattcatcctgaggcttcttcagatagcaaccaacttttctggattggcaagagggaaagtctaatgacacttgtttcctactattttctcctgctcccctgtgagggactttaattatgtttcccaaactttgctgtgcatgtgaatcacccgggaatcttgttaaatgtagattcaaattcagtaggtctgtgatggggcctgagattccgcattttttttctgttttgagatggggtattcttctgttgcccaagcaggagtgcactggtataatgataactcaccgcagccttcaactcctgggctcctgcgtcagcttcccaagtaagtgggactacaagcatgtgctaccatgcctggctattttttttgtagaggcagggtcttgctatgctgcccaggctggtctcgaactcctggcctcaagtgatcctcccacctcgggctcccaaagtgctaggattacaagcgtgagccaccagcacagcctgcatttcttaatacacttcctggtgatgccaatgttgcttagaggaatccacttagaggaacaaggttttagaatgttaaactctctctagcaaccctcccaccttttttggtgatactcaacccaaattagctggagtgttcgtgatgtgagagttacaaagaaagacttaagccaccttgttcaatattctagtcaaatgtttactaagcatctaccatgtgtggtactaagatattaataagtaaatagtctctgcccttcagaagttcacaatgtggtgaaaggttgtttgattaatctagcactggctctggcattactggctgacttaattagggtaagtcagcatctttggggggttcaactttcttagctgtaaaattagagttgagttggtgttaacactaaaaacatgactgttataagtatttgaggatggaaacacacacacacacacacacaccccttaccctcaaataatcttcctacttgatttttttccctaaatatggtttatctttgggaagatgatctctttccctctctgttgtaagtataagccagaaaagggttttaatcatagctgacaatgtaaatatagtgctggtgatactattttaaaggactaaaatttgaaataaaataaaaaataactagtgtcatgaacctctaagatctctaaaagtatgctacagtatctacaaatctctacccatgttctcatcatcttctaattaaacttgctttgcctc

SEQ ID NO: 948 - DNA, 3214 bp, Homo sapiens
agtcatttttatatgcggaggtaatgaagttgtcagcggcgccccgagtgtggcagagcctgatattcaaatcgccctgcccgctccgcctgctcccgcccgctggtcccgggagccccaggctgcgcgcgcccgcaccgcatcgccgctttgccccgcgaccgcgcgcgcctcctcgtcctcccccgcgcctttgtttccgtctccttctcctttccctcctcttttgtgtcgggccagactcagccccagaaaccagccaccctgccgcgtccgactgccagggatccctcacgccgcgaggtggagtctcgctctgtcgcccaggctggagtacagtggtgcgatcttggctccctgcaacttctgcctcccaggttcaagcgattttcctgcctcagcttcctgagtagctgggactacaggaagagacactagagagacactcagctgcagtgagaatacacaggcatcttcaagtaccagagatgtctccaagagcaccagcaaccccagctatctggatctgaagtggatatgctcagagacatcctggcccaccccaaagaagatgctgctgcactcagaagacgccagagctagccaccacccacactgcaagtctggaagctctgcaaggacccagcaaggcagcctgctcagcgaaggctttgtctcctgtggcaggaagagcaacattaagaacaagaaccccgggctggactacccctgagatttaatgaccagagctgagacccccaagaccacaatgactatggagggctgtcattaccctgcctgaccctctaatgcctctcagttcaaggaggccactgagtgaaactgaaggctggttttccttggaagccagcggcccatccacctgctccacttccctgcctcttgcagcctccgctcaaacactgtcgtggcttggcagcactacaagtatttcaggggctgccaagctgctctcctgtttcctcttccttggggctgattgcatcccatgatgtgcccaggttttgagatgctcctcgtgaatgaaaataggactgtctggttcctccatccatagcaagggagcctagacagaaataacttctgtgcatttctccagctacatttagggaaaactagaaaatacagaaatatatcaagaagaaaaaaaatttaaaaatgacccaaaatcccaccaaccagagacagctattaatgattgtggtatatttattgaatttactaaagtcatgctatacgctaggcactgtggagggactgcagaaagacttcaaggactgcaccgtcttgttagaaagatgcctagacaacatttgagaaacgctgatcatgtctgatgacacataactgctaacagttacatggaattttctatatgctatatacaaacatacaaatatatgtatgtatatttactcagctctcacaacagctactactgttattatgaatcctgttttatggtgagaaaactgaaacatggagaggttaagtaatttgcccaagatcacatagctactaagtggtggaactgtgattagaatccaggcattcaggctccagagttcatactcttcacataccacatctatcttgaatataacaatgtagagaaaaagaattatagcaagcatatgtctaggtaagcattttccagaagtgactgtttttttgcattgggtttgtaaactttcaacaataaagcaggttggactttatatcagtcaaagcagaatattctgatgtcaccttccccaatgtttaggatgttaatgagaattgctaatccaagagaagaaaataatctcatctaatttgggtaagtcaattatttgaaagtagaagaaccacccttccacctctcttgttctaaggaacctctgggggaagtactggaaaaataatgctttctaataagcccaatagggcttttgatttgtaataactattttaataagtatcagttcaattcctattatttttaagaagttcattgaatgaattaaagaacaaatgaatgagcaatgctttaggctataggctttcagaggacgtaattctatgaaacagactcagtggtatgctggcaccagctcctgcttgcgtctcttttcaactttgtgttcagtgactttgccttggtagcttgacatcagccatggtgggaatatttaaactaaataactgagaaaatgattcatattagagagctttcttttttcccgggaactaagtgttaaacatttaccagcacaccactgcctagacttgttaggaaattcacaagtgagaagaaattctgtgattccaggagatgaaagagggaagtgtaatgagaatatcaacttgagtattttatccgttgctttctttaattgggtcatttcagagggtgggtagattttgttaagacagttgaaatatttaggtaggtagaggggtgagtgcagttaaagagtaaaggctgtttggggcagacaaaagaatgatagcactctttcaagtgctctgccaccagcagtaaaagtcgggagaaggacctagcaccaggacacgtgatctgtccggcgtaagcgagtgctgagtcaaaggcctgcaattcaggcccctgctctggggcacggtcagtttcagccaggcccaactctctttcccaggtccatggcgtggatggcacccagaatccagcaggggagtgctggtggatacacctgggagggcctggtggaggatcatttgcgtgcagaaataaggaaatagacatatttgagctggaagaaaatcttacatgtctgatccaattctctcatttcacagataaggaaaaggggccccaaagagtgaagaggggatgtcctgaggtcatgaggctggcttacagcaaggatctggaccagacagcagggtgggaccctcagctgtccccatacttgctgcttgatattggataggttatttaggctctatgtgttttctcataaacacatagaggttaggtaaaaatggtggtgtgagaatgaactaatacatgtaaagagcttgcatgtagtaagctctcaataaatattaataatactgggcacagtggctcacacctgtaatcccagcactttgagaggccaaggcgggtggatcccttgaggtcaggagtttgagaacgccctgacaaacatggtgaaaccccatctctact

SEQ ID NO: 949 - DNA, 3043 bp, Homo sapiens
gtgctcacacgcagctggcaatggcaagtcagtggatttaggataaaaccgagaataaggaactttacattgtcaatgatcaaacacctagtgcacccatggccgtgcgtccgcaggacaaagcagcctttggagccctggaacttaagatgtccagagatcagcagctctcggctcaggcccaggcagctggacagcacccagcgcctcctccaggtcctcctgggtcccctcctttctttcactttcagcccgggaatctctgtgaagtcctagctgataactaaggggttaatgaataatcacagtgatgagctctggaggagccatggcccagagcagctgtggcctcctttgattaaaccacagaagtccggaggatcaggcctcaaacctccaccacctgccagctggcacctgtgaaggaggtgggaccagcacccacctcacagtggctgcagggtcacctgagatggtgattgcaaagtgctgagccatcgggacacatatttccaagacctcctgagtgccggctggcccctggagcagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctgaggcttcactgctctcctgagagttttctaagattaaatctccttcacaatgacagcctcctgtcacctgggccctggtgacaaagcctttggagaggcaaggacccagccggggcattcacagtgggcatgctatccaccctccgcccctgtcctggcccccacagtggagccgccaccttgggtaacaggggctgcctgaggtcctggagaaggaagaaccaggtggcccaccttcggtgcacagggaacagcagggacctgacggcagcccccgcacccctccctgggctgaagttcaggctgtctcatcccttgccaggagctcagggctgagctaggttggcaggggatgggttgagggtctgttgtccagcagattgcccgggccccacccaggccactcagaaaacacctgtgagagccccgcaggcatgcagggcactgtcgtgagcacaccagtggggacagacgtccaggcaggagggagcagccagacccccatcccgccagggtcaccaggtgagcaaggctggggaacaatggaggcggagccccgcgactgcccagctcactgcccccagtgtccaggctgtggtgcaggcgtggggacccaggtgtgttcaggggtctccttcagggaaggagaccaagctgggagtctggggaggctgaggtgtgaggtgacagcaggtgaagagtgagccacaattagcattttcacatgaaaggaaactacaggcctgggcgcagtggctcacgcctgtaatcccggcactgtgggaggctgaggtgggaggatcacctgaggtcgggagttcgagaccagcctgaccaacatggagaaaccccatttctactaaaaaaaatacaaaattagctgggcatggtggcgcatgcctgtaatcctagctattcgggaggctgagacaggagaatcacttgaacccgggaggcggaggttatggagagccaagatcgcaccactgcaccccagcctgggcaacaagagtaaaactccgtctc

SEQ ID NO: 950 - DNA, 3052 bp, Homo sapiens
agaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcacctaaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagctgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactgctaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatgtggtggttgagtgggtccgcacgaaatgcttgattatgtcagcaacacccaacactgtctgttttccatttgttggttttaatcataaaattgtcaagtg

SEQ ID NO: 951 - DNA, 2761 bp, Homo sapiens
atgcgcgcgcccgggcggcgcgggatctgggtctggggatgtggtaccggctgctggcggcggccggcagtagagcggtggccaggccgctggccttgctgtggcgatgtggtggcccaggaggcggcaggacggccaagaccagcgcgagggccctgggcaaggcccgacagtggttatggccagtgagaatgtgcggtgttgcattgcagaagaagctaggaaagctcatctggcctcctgttccagtgcttccaggggatccacgttcagaagctgactctgcaggcaagaccgacgttattttcctggtggctgtgttcaaaaccacccaaagggtttgagaaatactttaagaggagtggaaggaacacaaactgagaaacatcaacagcaccaaaaaaagagactggtgaactagagaatgctgagtctggaggagacggaggcaggagaggagggaagcaggataacgttgcctggtggaggcggatgcagaaggggggacttcccctgggatgacgaggatttccgcagtctggcccttttgggggcaggcgttgccatgggatttttctacctctattttcgagatcctggaagagaaatcacgtggaagcactttgtacagtattacctggccagaggtctggtggaccggctggaagtcgtgaacaaacaatctgtgcgtgttattcctgcccctgggacctcttctgaagtgaggggtgaatttaagacgtagctgggtgcgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggccagcaaggggttcaactctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctgatgtctgtttacataccaaagttaaaaagctggaatgttaccaagactgctttcttctgcccatagacggggatgactcagcactacccctcaacagagatgactttgatgactctgcccctcagcagggcttactaagcactaccccttaacagggatgactccacactgcccctcaacagggatgactcagcagagatgactcagcactgtcccttagcagggatgacacagcaaggatgattcagcactgcccctcagcaaggatgactcagcactgccgctcaacagacatgactcagggatggcttagtactgcccctcagcagggatgactcagcaccgcctctcaacagggatgactcagcaaggatgactcagcactgcccctcagcaaggatgactcagcactgccgctcaacagacatgactcagggatggcttagtactgcccctcagcagggatgactcagcaccgcccctcaacagggatgactcagcactgcccctcaacagggatgactcagcagggatgactcagcactgtcccttagcagcgatgacacagcaaggatgactcagcaccccccctcaccaaggatgactcagcactgccgctcaacagacatgactcagggatggcttagtactgcccctcagcagggatgactcagcagggatgactcagcaccacccctcaacagggatgactcagcagggatgactcagcactgcccctcaacagggatgactgcagggatgactcagcactgcccctcagcagggatgactcagcactgcccctcagcagggatgactcagcagggatgactcagcaccgcccctcaacaggcatgactctgcagagatgactcagcactgcccctcagcagggatggctcagcagggatgactcagcattgcccctcaacagggatgactcagcagactcagcagggatgactcagcactgcccctcaacagacatgactcagcagggatgactcagcaccacccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgtaaaatgggtggattttatggtttataaattataccttaataaaggtt

SEQ ID NO: 952 - DNA, 2566 bp, Homo sapiens
atcttaacagcgcgttcccgttggcgtctgaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgctaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggatagaaatgctatgaatgtgaggaaggtggaaaagctttcattattttcctcgggccttactgagcttgtgagcacattggatataaatgcacgtcctctggctgtaaggaatgtgttgaaacctttcgctctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 953 - DNA, 3254 bp, Homo sapiens
ttgactgatgtgaggtggctattccacctggttcaagatggaggtgtagagaaaagggaagtggggaacaaggactgggccaggtaggacggatccacgtaacgaggcccaagaaaaaatggaagctgggggcagagagtccaggaggcccccatgctgtctgaggggaggccggcatagcccctcctcgactgtcgcctgagcagctgatgaggtccccagcgccgcacgctgtgctccagggagaggagccaagaagcaagcaggctgctgggagtccctgcactgccatctggccgggacggaggcgcctgcccggtctccaggctcctctgagcttgggtcagctcctaatggagcatggcaccccagggaaccagaggaactctgtgaagaaaggcatggaaaaccggggtgtctcccgcacagcttcccaggagtcaggtgggacccaggcgtggggggacctttctgccccacattcctggcattccccccaagtttatttctactttccagaaacaagccacgggaagggaaggaacctgcagcagggtttcgaagacagccaggccctccgtgattgagggctcatatagccgctgagggcagcctgcagccaggtggcctcacctgctgcccagaattaggctgtgccttttcccagtccttccccatgccagagcctctccccatccttccccgcgccagagcctcacagccacagccacaccaacctccctcctctcaagcagcagaatcagcctacgctccccagcctcagtgcccctgccccacacaggtcatgctggcaaggcgatgaccagtttccgaaacgctggatccccaagggtacagtgtggcccagtcctcccccacctccatggtggcccaggctgcagggctcacggtgggcccacggtggaggcctcaggcagctttctctccagctacccattggcttaggacacacagataaagtagagctgaaacacgggccaaaacatccccagacaaggatggcacaagaggccaaatttgaaggccttgggagagaagccatttcccctacctctaacgagcgtagttttctgtctgaatggccccccttttcatgcacgctcgttcttaagagacgcaccatccgcaggcagcgtctcagtgaagcctgtcccctgggcttgtccacggcaggaggcccctggcctgtttaagccataccgatgcttaatttacatttttggagttgaatattattccggtgcctccaccacccccagcagaaaaaataagatactgaaataagttgagtcatttcgcaaacatttactgagcacctcctgtgtgccaggctcctagaaagacagggagttggtgccctgcacagatgacaaactgccccagacagcagacagaaagacagacaaactgccccagacagcagacagacaaacaaactgccccggacagcagacagacaaacagacacattgccctggacagcagagagacaaacagacacactgccccggacagcagacagacagacacgttgccccggacagcagacagaaaaactgccccggacagcagacagacagacaaactgccccagacagcagacagacaaactgccccggaaagcagacagcaaactgccccagacagcagacagacagacacacttccccagacagcagatagacagacaccctgccccagacagcagacaagctgccctggacagcctgctcaccttgcctgccacagtgcatgccccacagggagaagccttccttctcacccagggagtccagccattttcacctcccctggtccatgctcaggaagtctggtcaccctggcaaactgcacctgacattgaggtcccttttcaccaaagatgcacaaggtgtccatgccgagccgacatcattcaggccaagggcagaggatgtaatgaggggtggagtgaggatgtggagagagagcagagagcgcctcctattctaccgcggctgcctctgcccccacagcacccacagatccctggcccttccaggagtaagtcctgggcaggcagagctggggttggcctgatcccacctgccttgctcttggaaaggacatcaggtgtgggcaaagcatccttgaagcccagacaacacaggcatggcctgcgtgccctcccagcatctgctgcgatggcctcaaggcctctccagtcccctgctgcaccatgccactcagagcccctgagtgagccccctggaattgtctgcaccccccaagccccaacaggaagaagggaaaggcggggaagctgacgctcactcagtgcccactgggtgccaggctctgggctcaaccctctaatatccacacattccatccccccagccccgtgtagatggtggggttaagaccattcttcagatgtggaaatgaaggctctgggagaccacaggacatgcccaaggcaaagagttggtagtccctggatttgggaatcaaactcaagcccatctaatccaagggtaggaaatgtctctaaaacgttgatcaatctgaagcttacagattggaaactgggccaggtcagccctggcggtggagtccagagacagagagaaggctgcagggaggggagagaacaggaggatcccgggccagggtgacttcagtgacattccttccctccttcacaagcacgaaaaactcgttcggagaaaagacagcttctgccttccctaccaggcggacagggtactcactgtgccgacgtgagcagacacagccagaggctcaagtgcccttgccgagtgtccccactgctcttggggaggccccggcacagccctgcagagatgcaagtaagagagtgcccagtgccctcggcagatgggtggcagaaagcaggaggaggaagagggagctgaccgatgccgggtgtcttactccgctgagatcagaacctccaacatgccgagcagacgcaggccacattgctcggggaacaggacaccagggcgctgtgttagcggcccgcagacttcacttctggctcctgtgagggcactgtattgtccagacgcttggcaacgactctgcctgcaagtggcaaataccaacataaccacatcttccttttagttgccacaaatattcagttttgttttatccatcatgtcccccatatgcatgtaatgaaacatttgtgaaaatcactttaataataaacaggaaatgaacct

SEQ ID NO: 954 - DNA, 3396 bp, Homo sapiens
cttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcagatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagac

SEQ ID NO: 955 - DNA, 3222 bp, Homo sapiens
aagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagcccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctctggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttag

SEQ ID NO: 956 - DNA, 4334 bp, Homo sapiens
atgcgcggggcgggagtgagcgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagggtcttgctgtgtcgcccagactggaattcagtggcctgatcatagttcactgcagcctcgaactcctgggctcaagcagtcctcctgccccagcctccctagtagctgggacttaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaaaaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaaggagaaatgccctaaattgaataaaccacagcctcagccttcacctcttctaagtactcatcatactcaggaagaagatattagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgcctaagcctagtgctctagctcaagagacctctcttggtgcccctgagcctttgtctggtgaatagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctc

SEQ ID NO: 957 - DNA, 3636 bp, Homo sapiens
agttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccgccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaagaaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 958 - DNA, 2433 bp, Homo sapiens
gagcggatgccaccccgtttccagcctccggtgctcaccgtaatgctcacaacaacctagcaaagtggggatcatcttcaccactgtacagatgaagaaattgaaggtcagacattcaaggttatgtggccacatgagagaaataccagagctgggatgaagactcaacggctctcagacaccaggttgcttcttgagagaagccggatggatgtgcatgcagggagggaagttgcctctgaggaacggcctacagtggcttacaactcccgggagggatgtggaatctatccccccaacagcccatgaagacttataaaagctgacagatgcaaggttttcagccatgcctttgataagatactataaaagtaaagtagcttctgccctaaaagctgagcgctatttccagaaaatcaacaatggaaatgataggcatttcttttgaaactggcacattcataatggacatagaagaatcaacataagaaagtagcaggtattggtctttcctgtggtccctgatgttctatccacttgacctcttcaggaacattccctggaagcaggggaagtgctttgcttccctgtctcccgagggagaaagggcatttgatggcatggagccactctgccagccaggagccaggcccgctctaagggggctacagcatgcctcagattgctacaggctcctctcccctcccgggtccggccttgtcggcaccaacccctcagttcctgccccatctccccactgcggttgctgtcgggcctggagcatttcctccttcactttcacgggtcccacacccttcaagatcaacagtgaccaggccactccctgccatctgagaagcccagaaaccatctcccgtcagagggagattagcaatgaagctttctgacgtctctccctgtaccaggctcaaaaggaatttcatcctttctttccattcactgcaatgagctctcacactcatttgaaatgtgcggcctgatgacccacacacctctcaggggagccatggccccacggctgtctccccctgaagatgtcgtccctgtctgagcccctcctcattacaggagagaacgagcacctgccagcaccggcagcccctcgatcctaacctcagatggcaccctttgggtgcggagtgggaaaggaagaagactcagctggtgaaggctcagtacttttccttttccgcaatcactaagtaattttctcatccttgaaagcaattttctgctgaaattcagaaagaacttattttgaagttacgccagtaaaagctctggaaactgtgatgggagcttgtgctggaagccgaggacagagctccatgctgattctccattcctcttatttatttgcatgatctgagctaatttctcagctgtaatctacaccacccaccacctagaaacttcccagaaacgtccagcaggggaggggtgggaacgagaaagaaagcacccaacgctctggcagggtctgcgcagccgccagactctgtttctagacggtcacggccgacttagtaattcacttagaagatctcctgaaataagcacaaaatgttggcagcaaatggtcaaagggaaatgccccagttttcttaggggacggaccctgttactttatcagatagcagtgtgagctgaagtgtgaagacagggcagacactaatggtattttgttcatcctgaattttttttttggcattaattttgatctttaaaaaatattgcattaggaaatgtaaatgcatatgagtaagtgaaagaaaccaatctggaaagtctacacaccgtacgattccagctatatgacattctggaaaaggcaagaatagagaggcagtaaaaagatcagcaaagagtaaaaaataagtcggaaagggacaaataaggttcttagggtgtggagactacatctgtgtgatagtacgatgggtgggtacatggcattatgcatttgtccaaacccaccgaacggacaacaccaagagggaaccctgctataaactgtggcctctgtgcgatcatgatgtgtcaatatgggttcatcagctgtgacaaatgaaccccacaggttggggatgttgacatgggggaggctgtgcatatgttggggaaggtgatatgtgggaactctctataccttctgcccaatattattgcgaacctaaaactgctctcaaaaatatagcctaagaaaaagtaactttaatcttgggagttattgtttactgggtacagagtttcagttctggaaggtgaaaagagttctggaggtagatggaggtgatatttgtacaacaatgtgaatacttagtgccattgaaccgtacacttaaaaatagttcagacggctaactttatgttgtgtatgttttactgcaattaaaaaatgttacttatctt

SEQ ID NO: 959 - DNA, 2638 bp, Homo sapiens
cgctcggcgccccggccgggccactgggccacaggccacgcggccacgcagtccgagcgggagccgagccgggcggggcgagggcagctccgtaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtagaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttagtaccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccccgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctc

SEQ ID NO: 960 - DNA, 3144 bp, Homo sapiens
gtacctgggagtcgggttggggcggagcggaggggaggccgtgccaggcagggccggttcgtgcggaaccgccatggccgagccggcttcggtaactgtgacatttgatgatgtggccttatatttttcggaacaagagtgggagatcctggagaagtggcagaagcaaatgtataagcaagagatgaagaccaattacgagacccttgattccctggggtatgctttttccaagccagatttgatcacatggatggaacaagggagaatgctattaatcagcgaacagggatgcttagataaaacaagaaggacaactagccctcctactgatgaacagttgaacatgaagaatactggaaagttgctatgttttgatgacgaaggaactcccaggacaaaagaagaggattgccgtttaaatggtcctcaaaaacaggacttgtgtgctgccttacgagggaaagagagaaagattttattagctcaaacagccaccttccagtctccaagtctccgagaaacagagattctaaataaaaaagtcagcatcacagcatatgatccagacaagaaagacctgcggcataagcctcgggagaccccagggcgcttagaaattcccacagggccaagatgctattcctgctatgtctgtaggaaagtcttccaagtaaggagggatttgctaaagcacaaacggagccactccaagagccagctctgcagatacccaaagtacaaaaactcgtccagagggaagtccgaactcaggcggacgcagaggctcctgtgtcagaagaagcggttccagtgcagtgagtgtgagaagagctacttcctgaagggcagcctcgtcactcatcaggttgtccacaccggccagcggccctacccatgccctgagtgcgacaagaccttccggtacagggccaacctgaagaagcacctgtgtctacaccgcggggagcggccgttctgctgcggggagtgcggccgggccttcgtgcagcagtgcgagctcacggagcacttgcggctgcacagcggagagaagcccttccagtgtccgcagtgtgaccggtgcttccgcctgaagaggggcatgaaggtccatctggcccagcacagcgggaagaggcccttccactgtcccgagtgtggccggagcttctcccggaaggctgccctgaagacccaccagaggacgcacagcgaggaaaagccgttttcttgtggtgaatgtggcaggaaattcatctacaagattaagctggacgagcacatcagagttcacacgggagagaagcccttttcgtgtcccgagtgtaacaaaagtttccgcctcaagagaagcctgaaagcccacgggctgcaacacattgggaagcggcccttccagtgcccggagtgcagcaggggcttcttctggaggaacgccatgcgcgcccaccagcgcctgcacagcgagcaaaagcccttcccctgcgccgagtgcggcaagcgcttcacgcggccttccaagctcgcctgccacaccagagtccacgacaggcagaaggagtttccctgcggcgagtgcaaaaagaccttttctcagcagtcgcggctcacgcagcacctgaaggtccacaccacggaaaagccgttctcctgcgccgagtgcggccgcagtttccgccgacgcgcgcatctcacagagcacacgaggcttcacagtggcgaggagcctttccagtgtcccgagtgcgacaagagcttctcctggaaggcctccatgaagttccaccagcggatgcacagggacgagaagcccttcgcgtgcggtgagtgtgacaagacctacacgcatcagtctcagctcaccgagcacctgaggctgcacagtggagagaagccctaccagtgtcctgaatgcgagaagactttccgcctcaagggaaatctgaaaagccacctgctgcagcacagtggccaaaagccattctcttgtgtgatgtgcggcaaaagtttcactcaacagtaccggctcacagaacacattcgagtccacagcgtggagaagcccttccagtgtccggagtgtgacaagagctactgcatcaggggcagcttgaaggtccacttgtataagcacagtggagagaggcccttccagtgtcccgagtgtggcaaaggcttcctccagaagagaagcctgaaggcccatctgtgccttcacagtggggagaggcctttttcttgtgatgagtgtggaaggagcttcacgtacgtgggggcgctcaagacccacattgcagtgcatgccaaagagaagccctccagcctctaggtcaggccatgcagcagtcacgcagtcggctttcaggaggtgccagcagctctgttggctcaagttgaggcaggttgaaggattcacagggtaagatcgggcacagtggctcccgcctgtaatcccattactttgggaggcccaggtgggaggatcgcttgagcccagaagtttgagaccagcctaggcaacattgcaagactccatctctacaaaaaatataaaagtcagccaggcgttgtggtgcatgcttgtggtcccagctactttgggaggttgaggcaggaggatcgcttgagcccaggaggcagaggctgcagtgagccatgctcacaccactgcactccagcctgggtgacagagcaagatcttgtctcaaaaaagaaaaaaaatcacaaaatactggctacagacacactggacaggtgtgtggtctgcagaactctatggctccttgacaaaagttccaaataatccatagacagtcaaagagacatctccctcaataatcgtcataggaaagacgtgccagttgtggaggaaacattcacactgatctgctagtccaacgatctcttcagtgtcatccaataatcccttcattaaattcagagactacagcctgagtgaagaaatgttacagccaggaacatattcctcagtcagcttttccattaccaggccattttacttaaatctgtattaaagtcttcagttttctctcatagtggattttcattttctctcagatggtgagagggcttctgtttcttggaatgtttccatattgctaaaaataaatgtcttccact

SEQ ID NO: 961 - DNA, 3293 bp, Homo sapiens
catgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgaatgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttctccgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccactcccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgcccggtgcgggtgcgttacagatggacgtagctgccttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacag

SEQ ID NO: 962 - DNA, 2597 bp, Homo sapiens
aagccatcccactggcctggactctgctgggattattttgaccccccagggcagagtgtagccatctgactggctttctctctcggcaggagacggggcgcacgcctgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggtgtgtgaaacggagatgccagcccaggggctcagcttgctcgtgctctcatttaaaagcagaaaatagcgacttcattctcggatacgtttgccagccccaaaggattaattatctacacacccagaagcagtggagcagaatattttggcaggattttcaggatttgtgtcatcgttgcttaatatctgtttcttcacagtcggttttgggatttgagattgacgcggtgaactctgtccagttttcaaaccacacagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtgggcgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggataccagcgaggggccaggccgggccaggagcctgccgacggacaccagcgaggggccaggccgggccagactccctggccggctgggatctgacaggagcgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccaaaaaaaaaaaaaaaat

SEQ ID NO: 963 - DNA, 2978 bp, Homo sapiens
agttttcaccgatcaggctaatgagctgcacagaagtggcagctgaacaagctgagagactgtattaaagaacgaatatagcggggatggggagcaggcgtctacggtcccagctactcgggaggctgaggtgagaggatcgcttgagccctcaaggcggaggctacagtgagtcgagatagcgccattgcactctagcctgggaagcagagagagactatcaaaaacaacaaaacgaataaagggattctaccaagagtgagctggactgaaataaacgacacgctactacgacccagcgcgtgactatatccaccgcacaatgtgcgataatagcctcaatgcagagagaattcctcctttccttattcagtgcaagagagccctatagagaacgcaggaaatgcccgcgagaaactgagaagtatcagaacaatcacagatatgttaggaaagtagctccccgccacttccctaaacttatcatagcagacttactttccaaggttacaaacacaagaagagcactgtattttcatgaagcggaaaatgtgctttacaatcgccagctactaagagccttaacggtgaagcgctctgcaagaaacaggaaatcgtcaacacactttctgcatgaattgcctggagagttgtgtccatagacgattcctggttagatgcttaattgtagcagactccataacggggtttagcgggtttccattcggcagaaagggctccacgttctttttcacagaaaggtttaaacttatttttcctcctcaggcggacgaagtgagcgtcgttccgtgaagagctaagttcctaggaacgtcacatactggtgccatccaacaacatgacgacgtgcggaaccgaagtccccttccacctagcggcctctcgcggcgcaggcgtggacggggagatcgcgagaacctcccgcccaattgcgaccccgcgccaagaggcggggccgaaagaggaggaagtcgggccgaaagaggaggaagtctcgccgaagtactcccgccccagtcgggtacccctcctcgcgagagcgccgagcattccggcctgggaagcgcgtgcagaagcggaggtgctgctcatgggacttgtcggccgccgtagcccctgctaggacagcccgtgcgagcctgctggaggaggaagagaaaggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggcaagtagttgtttatctttaatttgaaagacttcatctgtgatcaaggaagtattaatctgacaaaggtgggaaagctttcctgacaagaaaaaaacatgtttggtaaacaaagatcatgtgtatttctcttgcaggttaaaagtttcagactgaaagtttttgtactggtgataattatcatttttggattgagccactgtcggtttattctaagatgtatttattagtattatttaactgtagttagccaagtctcttctataccttgtacatgaaaccttttattctgagtcacgtttaaaggaaatgacatagaacaaaattcaaagggatactcttaaagcaaggaaagcctgtttgtggtgtgaaattaaatcctttgactcaagtaaaggtagaggttttgaagtagaagcattaaatcctgctctttaattgttgtgtatttttaatatagtaatcaatggatactttataaaaatgtacattaccaagtatgtaacatcttctgttaatattgtcttatttgggaaagaaaatgtgtattgtattttagcatgcctgattaatctgaaaatggtagcagtgattcaatcttttttattctgtgaatgtttttgtttttattatgaaatatattaaaattgaaaagtacagagaataatcggtgtctactgtaacaccaccagatttaacaatgttaatgttacgccatatttgtttcaaatatttttgtaatattgaacattatggatagagttaaagcttgtttgtatccatcccgttgtttacattctccatcccctacataggtaaccactattctgaagttgatgtgtattctttgtgtacatgcttttataccttttctgcatatgtatgtatccataaataatatgtagtctgttgtgtgtttttaaactttacacagtggatgtcatactcttacatgtattctgcagcttgcatctttcacacattcattttgaatattcgttcatgttaacaatgtagatctagttttctttttaaactctgtatagtattcttatgtatgacatacacttgttgttatacatttgaattatttccaggtattcttttttgtgtgtggtatgtaaagtcacgatggcagagatttttgaaggaagataaattattttaggattacatttacagcgtcagtgcccacttcaaggtttatgaaaatttggatgcccagaaacaagtacttcgtagttggaggaataaaattctgtctgttgtgc

SEQ ID NO: 964 - DNA, 2648 bp, Homo sapiens
aggcttcgtggcggcggcggcggcagcggcctcacccagctcgtgggctcgggccgcggctcaggcgtcacgcatagcgtgggcacccacgccctcgccacccgacgaggatctcgggctccgcgacctgtgggagtgctgcggggcgtcccgcacttccgccctctctcgtctccggctccccagtcgccgccccgctcgccgagtgtgcgcgcattcgggcctcgcctcggagccgggaggctgtcctgtccccaggcccctcgcgcggccgctcttccaggcattgcggtgctagccccctctcccgcgcacgactggggagggcagaggtgtgagggatgcgggggtggctcgcagccgttcgcgggcaggcgggcggagcgcgggaagcgcggtgcgggcgctccatggcgcacccagacgctctccctcctccgcaggtgcagcggggcgttgcgcgagctcgagtcccccttcccggacagctagggagaagggagtttgcagaccggagctacagttggaagaatatagtttttgagaagttactggaagttagatgtgagacaaaaacagacgaactttccttcaaagccttatgacgaaatgataggccttgccatacccttgaaatgaaactgagctccctaccggcctaaagccgctgttcctgagcttcatgtaaacaaggagggcggtaaacaccagaggaaggccttacaacaataccaagtgcaagtagctcatttgagtgttatttatcttagcagcttccctgagtgatttatgtatattgcagtttaactttacagggtgggaataaaataatttggcttctcagctcactggcggaagaaactagagctgagctgggacgagggcaagaagcgcgtcgcacctttcctggcagctgaacagtgtgatgaacagtctggaagggttatgttattacttaaggggtttggggaaaccgttcccgcgcacagaccctcattcgggccaactgcaggccgtgggggactcttcaaggactcgcgcaacccgagccgagcttcctggctgggcactgggctcagccagtgctgagagcgctttcgctgggccagtcaagacagcaataagtttgcctctatttgggaaacctttccaggcttgcctgccctcttttaagagggagactaggtggtgggatcgtcagctgccaatgtgtgcactcgttctaaagaaggcgagaggaagtaaagcgaacctgtgcagtgtttgctgggcttccaaaacgcggaacttagtcgaccccccagcgaaccggacggcgctttggtcccctcacacctaacggtactcagagcctggtgcgggagctggcgcgctcgctcctggtttccttccaatttaggcaaaggccctggccgcccgtcttcctgcttctgctgtgccctgccacagcactcctaagacggcgaattcgtttctgcgccaattttgttttgaatatctacaaaccacttttccttgcatgaagaaaacaaggcagggccccctggcccgtcccacacctgcgagaggcagagatacagaggcctcgggcctcagccttcatttccccgccctagcttcgcgccaagctgcagtgtccccgacacactgtcaggacacgcgcttttcgcccctactttgttcttgcgcagtcttcccagctgcggagaggagggagcgaaagcaaaacgaaagcacccggggcgcatcagttgcaatagcttccctgagcgcggccgtgggaggccaagatctgaggtcgcgaggcgacggtgggagcccgagctgcgcagaaactgggtgggggcggtccctggagggcgcccgggagctgctagaagttgtccggagcccctcaacccccttggaaaagcgaacgcggatgttaatataccaactccgcagggaacttttggcccgggtcttgagctgaaattccagactgaatgggaccgtgctgaaagttcgacgaggcaaaggagtatggcgcgggggcaagctttgacccccggcttcgtatcctcgggagaggccgggactccggctcgcccagcgagggtgcgcagaggcctcctgggattctaggcccacagaatttttgctccagtgaagttggataagcactccgcctccccgcaaaaaccagagttctcggcttataaacacttcaataaactctggtgacattctccgcgctcgctccttgccctcgcggcagtcactgcagggacaaaggcggcctgcgcagacttggaagaggcgcggcccgcgtgggcggctttaccggccaaagacgttttcagttaaggggaggcatcttcagagctgagggtaactccccacagccaccccgcaggtagggcagccaaccccaatctggtcagcttaaaagtgtcctcggtttcgccccctttcccagcgaaccaacactggcagattggcctgcgagccgctcgctctgttgctctagcacatttatgtagccaaacggtcgaagagccccatctttaagcccaataaacacttaactttattctatttaataacacattttgttgtggcaatatttgtggattttggcaggtattaaaatctggtgatcctaaatg

SEQ ID NO: 965 - DNA, 2471 bp, Homo sapiens
gtgcgcaggcgctgagtccctgctcggctgtctcggtggtcgccgccggggtctgagcccgggaagaccgagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacttaagaaagggcattcagggaagaaacctttaaaatgtaatgactgtggtaaaacctttagtcgaagcttctctcttaaacttcatcagaacattcatacgggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtc

SEQ ID NO: 966 - DNA, 2976 bp, Homo sapiens
gagcagcagcaagatttattgtgaagactgaaagaacaaagcttccacagcacagaaaggaaactaagcaggttgtcgctgcaggctggtggggagcctggcggtggccagcttttattcccttttttggccccgcccacatcctgctgactggtccattttacagaccactgattggtccattttacagaacgctgattggtcaattttacagagtgctgattggtgcatttacaatcctttagctagacactgagcattgattggtgcatttacaatcctttagctagacacaaaagttctccaagtccccacccaacccagaagctcagctggcttcacctctcaataatgctcaccaacttgttaaccataacaaacccactgcatgttactaataagtaacactgtcacaaaaagttattttacaaaacaaaaccagttggggagaaggatggcactgttttccacctttgctggattcccctatctgctctgcacagccttggtggaagtgagtggagattcagcctcccccaggtacgcggctggacgaaggagtatttgagcagcctttctgatcatcgtggtcttcctatttgaactacatgaacccaggctgggggtggtgagctagctacctggcggagctggacactcatgaaccagccttctgcgcctggctgcactgaagcccacgggcccacctctcactgtcaatggatcttcacccacctggcaatggttcaacatcagaacttggccgtgtgggaaaagctggctcaccaatagaagagatctgggcactgtcggcatgtcttcaggcagtatcacaaaactgcgctgctaacgccatctcacgtgaaaaacctctgaacacccatgtctcaaagttaagggaagctatgaaggtcttggtggtggtggcaagtgtccagaattctgctattcacttgaaaatgtaaatttcgccagcaacaaatagtgtcatatgttttccttaaagtggcaggctgtgttcaggagaatgaacagccacataccagtggtcattcttccaatcaaaaatggggcaggaggttgggaagatgccgcattctgttgctactctggccctgggggaagcgcttcttgcggggaagcggtgtgccttggtctgtggcagacacacatcagtgtccttcccatgttttccgacccagaatattcgaggggtgtgtacgcaaggagcaagatttaatgcaatttgtcattgcttttctgctttgtcaaaggcattcttcagtgagacaggcatccccgcaagtgcacaccgtggtgaaggaataccatgcccccaagcaggccgggcactgctgccctgcacgctgggggctggtggtctgcacggccctgtcttcataccatccaccaacatcaacacaaggagaaggctaacagagtctcagggttatcaagagaatcattttgaccccacagactccctgaaagggtcttggacccccgggggtgcatagaccacattttgagacacactggtatagacagggtggacagcaggggtgtgagagctgcccaggcaggtgtcactcacgtgcactatggctaggataggacccctgacagtggcccctgctgaggctcccacagagacacttcaggccagtgccaaaggccaaagcagggctggcgtggtactgaaaacagcccgtcaccgtggcacccccacagggctggggtggcactgaaaacagcccgtcaccgtggcacccccacagggctggccatggcgtggagccaccgacacagggatgctcacacattcagacacacatctccagacacaacgcctcccactggcacagggaagagacgtgggtctgctgagcataggattcagccctgatggtggccctccacccccaccagctggtgccaggacctactcgatcatggacagcgccatcctccgcatggtccctttgtcgaagctgctggtgcacggtgagggcgaggccatcttcagcaagctgtgggactgggcgcttctctccagcatggcctgcgagagctcgatggagaagtcgcacacacacacgttggactcaaatttcgtctcagcactgcacagactgccccggtctgtgtttcccaacacgtcctcaagcccgctttccacatggccaaggctgcccttcaccaacggggagtcccccttcagagagctgctcctgtggtctatggaccccccacactgcccggtgtcctggaagtggccgccctcgtggctgcctgagacgcgtggcaggagcagtggtgctggcggtggcctcagctcatagctaccctgggaaggcacgttcacctcatagtacagagactccaggtttgtgtccataaatgatgatgaaaggattggaacaactgggaattttggaggttcctggggctcaggtatggtccgttcagcaacattgggcttgaaggactgggcggggtagtggaggaggaaacacatgctgagtgccgtgagaccctcatctgagcacttgctcacgtcggccccacagtccaggagaaggttgacaatgtcgttgtggcagtgagtctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccaggtgggcgggccttttccagtg

SEQ ID NO: 967 - DNA, 2747 bp, Homo sapiens
attgattaaaaagagattgccctgcaaggtaaatcagttaaaaccaacctctcctgccctgagtggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcggaggagcagcctgctcaccctctccaggtgggggctgtgtacctgggtgaggaggagctcctgcatgacccgatgggccaggacagggcagcagaagaggccaatgcggtgctggggctgggcacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagctttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctggtctcaaactgctgacttcaggtgatccacccgcctcggcctcccaaggtgttgggattgcaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctc

SEQ ID NO: 968 - DNA, 3362 bp, Homo sapiens
agactccctgtctttgcggtttgggagatgatgagaaaccacagaattgctagtagtttatgtggagatcaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcgaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagat

SEQ ID NO: 969 - DNA, 3059 bp, Homo sapiens
aaaacgcggagtgtcctggagcttgacgcgctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctggctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccagttccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagcttgctgcacaatgcagacctgtgtcttgctctctgggtaaaagccataaaaataagaaactcagcctgtggcctttcttccaaggctggagttctcgagttcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatcagaataacccagaccaaggcttaattgtaatagtgaacattaatggtacctttacagagaaattataggccaagagaaaatgctggctttcagtagaagttaatattagaaacccaaatctggttctgaaagtgtgtatcagatgtacggtgaacaaacttgggaaagattctctttaaaaatcaatgagcgttggccaggcacggtggctcacacctgtaatcccagctgtttgggaggctgaggcaggtggatcacctgaggtcaggagttcaagaccagcttggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaaaaaaaaaaaaaaag

SEQ ID NO: 970 - DNA, 3136 bp, Homo sapiens
gtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgacccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaagg

SEQ ID NO: 971 - DNA, 3301 bp, Homo sapiens
aaaaggtgccgccccggtctctccgtcccgccccgagcacgcccctcactccgcaccggccaatggcaccgccccgtccgccccgctctgggaacgccgctccagcagatgtgacatagactggaagtgatggacccagacaacaatcagaaccaaagcaccagatgagccacctcagccacgtgagccatgccagccaccctacctgtgaccccatctgtggccccagttatcatggagtagagaaagaaagagcaagagcaggcaggagggcaagacgacagcaagagaacaagaaagaaacctgaagaaaagaagttttagtgaagatggaaaggcttaaaacataccatggagaatgacctcagccttctgtgtggaggatttgcacttggagataaggaaagagagggacttcagagagttaagcagttcagtttcctttgcatttcttacatctgagcaggtgaccggagtgaacactctggaagccacagtggagtcctctgcttggggcctctttctggaaaccagatcaattcactgaaaaacaatttgcaaatgactagttcattgagaagcaagtgaccaaaactctaagtcaccgaatgacctgctcattgatttattgaagattttattccaaggtctacttccctctgcatttgtggctgccatttcatatgtgaatgggtgggcagtttgctgtcatgccctttttgtgcatctctatcctgaccctgtatgtggtgctgccttttcccaggccccctgcccctgccctggcctctgtctgcaaagcagttgcagcaacctccctcttgctgttgaagatactcatctgatgtctattgtgaattggctggagcccttctacaggtttgttagcgtccctctgcatccaggctgatggtgcctgccatgcttctacatgctgttctctgccacccacctgagcccagctagagtcagtggggaagtggaggagccacatcaaaacagtgtgtccacctcagtcaccctccagtgtgcattgacgaccaggcagccattagacccaaatgcagccccacagcatagaggcaaatggaaaggccacatatcctcttttcattctccttccatgtgaggccctgcagagcctggcatctgtcttcatcatcgtggcatcctcagactctttcttcttcctggagcgagctgtgctctctgaagccactgcctgtgtgggaagtaccccagcatttcttcgctgttgccaggcatcccttcctgtcctaccacttcaaatgcatcttttcatgtgtccttcctgagcacctctagcagctgcatgttcctgtttcagcctctgcctttccacagctcctccaagattcctctattgcagagcacagcaccaccttgcaggaaacctcccagaggactgtgaggaccatgaagcaaggggctgcatcttattctccttggtgtctggcccagcagtgggcccaggccagatgccattaagaacattcatgattcatgagaggagatcaaaatatcaacataaacaggagtttgaaagaagttgatttcaacccttgtggatgactatgagagattcaaggcttcagtggagaatgcacctacagatatggtggaaacagcaaaagaaatagaatcagaagtggagcctgaagattaaactgaattgctgcaatctcatgataaaacttgaacagatgaggagttgcttcttacagggttaggaactgtcagagtgtggctcaactgagaaacaactttctgagtagaggtggggaaagatgggctaagaggcttctgaggtcatgtgttcaccatcactgaggcactgtgatgtgttaggtgggtctgaaccctctggcttcagagagagtgcctgtggggcaccaggtaatccgagactgcagctcagagattactccagcaaagggtcaggtatccacactgcctctgctacctgcccgttggtcactcactcattgttctgatgataagatcgacagatcacaagaaggactgtggcttgaagttccagagcagagatgcacattactgtctaccgctgaagtgaactgctgcccctctggagtctggatatcatcagaatgaaaaagcgagtgtcatgggcaaagcgaggagtccagcaggatggacgctgtgtggtttctcagctggagcgcagcaggagcaagcgtggaaacatccttcttttctcttctcccctcccctccccaagtgcaaatggaacctgtgaaatatggcttgattttgaggcttctaattcttcattgcactcccagacccttcttttatctctggtggcagccctgagaataaatctcttggtcacattcttcaatcagtttctcccagagaaaaggttaggctgcaaggatgataggaaccagacttcaaatgggtttccaggagctgagggaaggaaaggtttttcctacagtttctccagccaagggattaagaaaaggatggggtcatagagcaacagcagtagaaggtggcattccaagactttctccaggactccacctaaggtcagtttctcgtcactcatacctgtttgtcttttgcctggccaccatcaatgtagagttaagaaccaggaggcaggaacatgctccccaagtcacagtctgcctcccacatactgcagtttgattacagcatcctgcctctccacaggaggaaagtggtgtcattctccagaaccaggtgtggattgtgatcagacctagaattggctaggtaaaaagcttaagagagagattccatgtcctgcaacactgtccacaattcaaatctgtattcaaaataaaactaaaagcagagaaaatccacagcagacctaccactctccaggcagatagtgccctctccacaatctgcagccatcaactgcctctgctggacgctgcccagatagagacctgctgctgcagagcagctctgtgtcagccactgcggccttagagagagctgcaggaaatgggacttctcacgtgctctccacagtggaaccacaggtcagcagctgaatggagcctctaccctctggatgcctttcttgtcacttagtattcttttttttctcattctggtactttatctgctggaaactttcaaatgtattactaatgtccttccaaacagactccacatgggaattttcatgatatcttggctatatttacacaaagattagcttgcaggaaacacaaaataagtatgcataaataaatgagtggctcagcacacc

SEQ ID NO: 972 - DNA, 3170 bp, Homo sapiens
gtgcttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagttccaggtgtttctgtctctggcttggagtccaaggacattttcccaaggttcaagcctttcactgatgctgtgggaatgccacattttactagaattactatgtagcagagtatgtttctagcataatgaaaagtatgctgtcctgaggagcagctgccattacatcacggcctttcgcacctgcattgtgactaaaattgttttattagcctctcttgcttccttgttctgtggaaatcagaggctctctaaaatattcctaattttatttttgccttgggtcaaaattatataacgcatctatatgagttatgttcaatactctgacccatcactgtattccttggagtatactttctttcttaaagagataaaggtatggaacaagaatcacagatgggctatgaacctcctgaaattgtagttcgaattatgtgtttgtgtgaatgatgcttactgtttctgattttatttgattgttgtataatgaaaatgatgttggctaatgatatagaaattaggagaagaaatattgaaaacacacacacagtattttattcatttgtccagaggacatgaaaatttaaaatggatgcatgaaagatattgattatttaattatatgttgtgtcacattatatgattgttaaaggcaatctaataaaaaaggtagagagggttaaatattaatttaaaaggctgtcacattttgaattatcttaatagaaaggtcttttgtgcaaaatgagaggcagacattattgcagaaaatgccaaaaaaagagaaagaaatttccaacaagtagctgcaaaaaaatatgtgaaattgagaatttaataagctaaatatctatttttgaaaagttgatggtaaaaagaaaggttataactagaaaggaatttagatattaataatgttttgatggaaatgcaatcagaagaggcctattattgttatttaggtgcaagacagcacaatttgatcatattgctggaaggacatggagataaaatataatatttcttgttattttaacagagaaaaatttggacctaggaaagttactcattttaagaccacaaagatagtaattttgtctcaacatttcattatgaaaatcaccaaatgtacagaaagttgaaagaatcatgtgaattcccacttacccaacatctgaattcttcaaattacattttttctgtttgttttatcacatatctacatcttttcatccttctattcatacctctctccatcttagttttgatgcattttaaggtaagttgtagacattagtatactttacctctgaacgcttcatgcgtatctttttgtgagacaaaatttatatacatgaaacacagcgatcttaatttgctaaatgcatgtacctatataacactatcatgacataactatcatccatgcaaattttcttatactcaatttcacctttacagaagcaatatctgttctgatttttacccccaccatggattaggtttgcctgttctagaacttcatgtaaattgaatgacacagtatagacttttaagtaaggcttctttttctaagcatgattttttgatgctcatccgtaatgtagcatagatcaatattttcttattgttgcatttcattgtataactatatcatagttttttcaatcccttgttaatagacatctgtactatttccaggttttagccatcatgagagtaaaagctgctatcaacattcttaagtattttgtggctatatgcatttatttctcctaggtaaatacctaagagtgaaatctctgggtcatacaataagtgggtaaatgttcatattttaagaaactgacatcttttcccaaaatgtttgtatcattttttatactcactaacaaggtgtaagagttccagttccacatgttcatcatttggtgatcttggtctaatttagtcatgctagtgggtgtgtactggtaatacattgcggttttaatttgcatttatctgattgctaattatgttgaacactctttgatgagtttattggccatttttaatctttgggatgtggctattcatatcttttgcccatgtttcattgggttgcacttttattattgcgttgtaggaatattttgtgcatactagatattagtatgtcatcagttacatgttttgataatgttttccttctagtctgtggcatacatattcatttatttaatagggtcttttaatgagcagaagattttaaatttcgatgtagtataatttatcatttcttctagtccttagttactgctttctgtgtcttaagacatctttgtcttccctctaaatatgtttccctcttattctcctgtttgcttttagatgctttatggtttccatttttatttttaggactacgattctttctaaattaattgtgtatatggtgtaagataggtgtcaaagttctttttttttttttttttttccaagtggatatcaatgtgttccagcaccatttgtgggatagactttctgtttctcaagagattgcattggcacttatgtaaaaaaaaataaatcaaatgactatttaaattt

SEQ ID NO: 973 - DNA, 2761 bp, Homo sapiens
actgcagccggaagttctcggcggtggaggagccccgcggcaaagttgcccacggagaggctctgctgcacgatctcgcgcacctccttgtcggacagcaggtagggagagcgcactgggaagctcggtgaaggaccaccacctcatccaaggggatcttgcagaagtccttgctgctcctctcaggggcagcgggggaccctcaaactcctccctgaacctctcaggattgattgcatagctcctcatgtttctacactcggggccagcacgtggaccttgcactgctgctggtaggagcgcctctgttcgtgttccagtgcaggttgcccatgaactccagggtccagacgcgattgtttttggtgcagaggtagagcaggtgcacttagtggcgaatgagcttgatgcaggacgggtccagctgcttcttgcccagggagtcgctgcagctgtactgcttgtgcaggttgtcatgggtgaagagcttggggaacaggggcaccagcaggcgcgaggtgaagttgccgatggacaggctgctctcctagatactgcgaagatgctcgttgctgagcaggcagtcggcgccgggcaactccaagttgggctggggatctccaatttgtccaagtcgataggtaccagtcagatcttcttggagcggcaccgctcgcccttgaagctgtcctccaccctgattactgagatgtcatcgggcaggctggaggagttgtagcagttgtcgcgtggggggcttgccttcgctgcccgcgtccagccccaggccctggagcttgtcgttgatgcactgggcgcaccgctgcagccaggcctcctcctcctgcatgtgggggaagtagacctccgtgtagttgctgatgatctgcagcctctgcgggtccagctcctgcttgccgccgtccccgtagcagctgtcctgctcacccagcttgctgtagtggaagagctcagggaagagccagtggaggaggaagacggcaaactcaccgggtgaagaggcttcatccaggaactaggtgagggcctacatgtccaccacgtggtctgaggcgatggtgctgctcctgtccagagacaggccctcctcctcatctttgtggtccaggaagtggccggggtccactgctcagcctcaagctggcagcctggccaccaggctggctgttctccatctcccgctgggcccagaagcggctgaagaacttactcagctggggcaagcactcggcctgtcacacagccctctccttcaccgaggggtagtagacctccatgtagttgtggatgagctgcaggtgcagtgactccagcttaagcttggcctcaaagctgcaggcactgcagccttgggagaagttgactgtggctgaagagcttggggaagagctgcaccagcagccagcaggccaggaccccacctgacaggctctggtccaagatctgcttgagctccatgcccgtgagctgctatggggtggtgggggtcggctggaatttggccaccatctcagtggggttcaccttcagggagagcaggtccactttgctgtgcagctgggacctgttggacgtgagcgtgttgagcatgtagaacatctcctggatcaggaagtagatgttagggtcgctgttggtggctgccccagtgctgccacagtcccatttctatggctcattcaggagcctaagcagcaaggggctgttgctggcatttgccttctggaagagctcatatgtgtttagcaggtcccctgagggagggttcttcttctccatgaccttgtgcgagatgccatacagaggcttcttgtagtaaggggtggtggcatggttgcggggctcctccttgcctgcccacacagagcctgagctcctgccttgccagcctgctctccattgccttggcagggcgagctgttcttgggttccacatgcctgctaggagcgcctctgggatcagctacctcctctccacactggggatggagtctggctggccattgctgaccagctgagtccttgagggcagtaaagacgctgtccagagggtgcttctcagaagtcctggaattcacggagcagcctagagcagcatctttggcctctgtctccactctcacttcttagaagttcttctacatcaattttttttggagatggttctgactctgtcacccaggctggagtgcagcagttgatcagagctcactgcatccttgacctcccagactcaaaagagcctagctacttaggagtagctaggactacaggccacggccaccatgcctggctaatcttttaaattttttgtagaggcagaggtctctcactgtgttgcccagacaagtctcaaattctcgggctcaagtggtcctcccaaagtgctgggattaatggcgtgagccaccgtacctggccatatttttttttttttcaaaaaattcatttgtagagtttaaaaagtatctttcgatcaagagttcttattgtatttatgtttgcaaatttcatttcccattctgttgcttgccttttcactcagtgagttattttatgattacaaatccctaacctcagcctatatctgtctatctaacctatctatctatctatctacctacctatctatctatctatctatcatctatctacctagatagacagagatatctatagatagctatggtaaattttgaaacacgttccaaatacattataataaattgtgtgttttgct

SEQ ID NO: 974 - DNA, 3005 bp, Homo sapiens
attactgttttttaagtggtagggctcacagactgtgtgaagtcctgtgtgaagtgctggtgtggccacctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcacccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccgttcctcagggcccacgtccagggggaccaagacctgcattcctagggccgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttaagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggcgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttacggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacatttgtcatgtcagccagccagctccgtgggtgagagtgtgcgtgtgcgcgtgtctgtgtgtgtgtgcgtgtctgtgtgtgtgcacgtctgtgcgtgcgcgtctgtgcatgtgtgtgtctgtgcgtgtgtgcgtctgtgtgtgtgcgtctgtgtgcgcgtgtgtgtgcgcgtctgtatgtgtgcacgcgcgtctgtgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccagctcgtattccgatcagtcgcttccattgttagcatcgtacacgattgtgatttttatgtcaaaagaagccaaaacttgcaatactatttttagcagac

SEQ ID NO: 975 - DNA, 3111 bp, Homo sapiens
gttcgagcttcccggctgctttgtttacctaatcaagcctgggcaatggcgggcgcccctcccgcagcctcgctgccgccttgcaggttgatctcagactgctgtgctagcaatcagtgagactccgtgggcgtaggactctccaagccagtgagatgaactcggtatctcagatggaaatgcagaaatcaccgtcttctccatcgctcacgctgggagctgtagaccggagctgttcctattcggccatctttgctcctccctgcaactaactccattcttaattgaccatcaaggaaatttccatccacacagattagcagttgaaaatgaagctgcacacatacatgtaagagaagcaaaaatgtcagatgatatcaggaaaaggtttgaatttccaaattctcttatccaatcacaggctgtgggtcatcttattgctgcagtcctaaaggaaaatggtttttcagaaaagattcaccaatctacaaatcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccagaaatacacatggcttgataaaagccattatgcacttactacaaatgcaagctcttaaggaaggacaaggtggggaaaagaatattcagagtatatataccattagaaatcatcctcatcctttgataactgtgcttgaacacagacctgattgctggccagtgtttttgcagcagctgacagcgtttttccagcagtgccctgaaaggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggattttcctgttgaactggtcataattggaatagctttactacttctacagactccagcaagtcagcagaagccaatcttaaatctagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagtagattcctcccaggtgccaaatctgattccagttttgatgttcaaattgggaagaccactggaacctatattatataatgatatattgtatactttacctaagcttggtgttcacaaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttagtgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagtt

SEQ ID NO: 976 - DNA, 3311 bp, Homo sapiens
gtagtatcctgggagctgcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactccgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaagtgggaacttcatgaggccctcgaacatctgaagaaagagcaagaagaggcctggaagcttgaagttggtgaaaggaaacgaaccgccacctggaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccacagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccagtagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcgctctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggggtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccacc

SEQ ID NO: 977 - DNA, 3310 bp, Homo sapiens
cacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagctccagccaagttttagaggaaacttacatgcttgctgtaactttggatgaatggaaaaagaaactggaatctcccaacagagaaattattattttacacaatccaaagcttatggtgcattaccagccagttgcagggtctgatggttggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatgtatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtg

SEQ ID NO: 978 - DNA, 3989 bp, Homo sapiens
gaacagtctgggatttctttcactgtgtggggcctagaatctcaggaagccaggacgtgggaaagctccaaccatggccatggggctcttccgcgtgtgtctggtggtggtgacggccatcatcaaccacccgctgctgttcccgcgggagaacgccacagtccccgagaacgaggaggagatcatccgcaagatgcaggcgcaccaggagaagctgcagctggagcagttgcgcctggaggaggaggtggctcggctggcggccgaaaaggaggcactggagcaggtggcggaggagggcaggcagcagaacgagacacgcgtggcctgggacctctggagcaccctctgcatgatcctcttcctgatgatcgaggtgtggcggcaggaccaccaggaggggccctcacctgagtgcctgggcggtgaggaggatgagctgcctgggctggggggcgcccccttgcagggcctcaccctgcccaacaaggccacgcttggccacttttatgagcgctgcatccggggggccacggccgatgcagcccgtacccgggagttcctggaaggcttcgtggatgacttgctggaagccctgaggagcctctgcaaccgggacaccgacatggaggtggaggacttcattggcgtggacagcatgtacgagaactggcaggtggacaggccactgctgtgccaccttttcgtgcccttcacaccccccgagccctaccgcttccacccagagctctggtgctccggccgctcagtgcccctggatcgccagggctacggccagatcaaggtggtccgcgccgatggggacacattgagctgcatctgcggcaagaccaagctcggggaagacatgctgtgtctcctgcacggcaggaacagcatggcgcctccctgcggcgacatggagaacctgctgtgtgccacagattccctgtacctggacacgatgcaggtcatgaagtggttccagacggccctcaccagagcctggaagggcatcgcccacaagtacgagttcgacctggcctttggccagctggacagcccggggtccctgaagatcaagttccgttcagggaagttcatgcccttcaacctgattcctgtgatccagtgtgatgactcggacctgtactttgtctcccaccttcccagggagccctctgagggcaccccagcctccagcacagactggctcctgtcctttgctgtctatgagcgacacttcctcaggacgacactaaaggcactgcccgagggcgcctgccacctcagctgcctgcagatagcatccttcctgctctccaagcagagccgcctgaccggtcccagcgggctcagcagctaccacctgaagacggccctactgcacctcctactcctccggcaggccgccgactggaaggcggggcagctggacgctcgtctgcacgagttgctgtgcttcctggagaagagcttgctccagaagaagctccaccacttcttcatcggcaaccgcaaggtgcctgaggccatgggactccctgaggccgtgctcagggccgagcccctcaacctcttccggcccttcgtcctgcagcgaagcctttaccgtaagacactggactccttctatgagatgctcaagaatgccccagcgctcattagcgagtattccctacatgtcccctcagaccagcctaccccaaaaagctgacgtcttttacagaatgtgggatcctcgagctaagatgagggcatccctcacgttcacacccctggtggcatctgccagccctgttctggggacaaggcgggctttcgtgggagccgtgctcagcctgccaggaagccaagccctacagtgcagaggaaacagaatttcaacgggaagctggtttgcttcataccattgggatctgctggtaaagctgttatttgggtttagggactgatcccttgcagtttacttctggatcaccatgaatggccaagatggtggcagaacacgctgtggaccctgagttagagacaatgcaaatgttggattgggtgtaattctttttgaatcccagatccagtctgtacttgaatatgagcagaggatctacaagaatgctgacagggaaccgtgttaagacccagcacccctattcccaggagcttctggcctgaccatctgcagccaaagcactaacagggacagatatgggaatgtccacctttgatccgcatcctgcacaatagtggtcccaccatggctgccacttttttatactatttggagaaaagaccttgtataaattcgaggcccgaatgactaacgtctctgtcacacggaaatgggtacttggtggcatagagaaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattttggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttctggccctgcgtcctgcagcgaagtctctgctgtaagacagtagactccttcgatgaggtgctcaaaaatgctacccggggtggtggtgtctggcttgcagtctggcccagttcagagaaagttgcagagatcaggggccaaggatgtcatagccccaggttgtcctcagggtcccaatcctagggcagggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttaaaaaaaacagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaaggaagaattaaatcttg

SEQ ID NO: 979 - DNA, 3540 bp, Homo sapiens
cttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagaatctctcctgtttgcaggcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggggatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggagaaagaggaagatgatgatcagcccctgacctggctccacaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaat

SEQ ID NO: 980 - DNA, 3313 bp, Homo sapiens
gattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactacaactgtgatgatccactagcatccctgctctctccaatggctttttccagttcctcagacctcactggcactcacagcccagctcaactcaactggagagttggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctggacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctataaatcagacgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgagcttagttttggaggaattccagtaccaggaaaacctgggacctttttaaagaaaaacttccatggatgcatcgaaaacctttactacaatggagtaaacataattgacctggctaagagacgaaagcatcagatctatactgtgggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggcagcaacttgaatgatggcccgtggcactcggttagcatcaacgccaggaggaaccgcatcacgctcactctggatgatgaagcagcacccccggctccagacagcacttgggtgcagatttattctggaaatagctactattttggagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtgtttgccaaactactgtgaacatggaggaagctgctcccagtcctggactaccttctattgtaactgcagtgacacaagttacactggtgccacctgccacaactccatctacgagcaatcctgcgaggtgtacaggcaccaggggaatacagccggcttcttctacatcgactcagatggcagcggcccactgggacctctccaggtgtactgcaatatcactgaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccggatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggacaaatgatactggctttctttccttcaaagaccacttgcctgtcactcagatagttatcactgataccgacagatcaaactcagaagccgcttggagaattggtcccttgcgttgctatggtgaccgacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtagggggaacgtcatccagacagaaaggcttcctaggatgcattcgctccttacacttgaatggacagaaaatggacctggaagagagggcaaaggtcacatctggagtcaggccaggctgcagcataaagaaattgaaataaaagtttaaaatagtacccggttcaatgaaagagcctaaaccatcttaactcagcttt

SEQ ID NO: 981 - DNA, 2685 bp, Homo sapiens
atattttttccgctccatcatgaacagctctggcatacaaatgcaatctctcgggctgggaagccgccagctccctgcgctttcttgcaccgaatcctcacattgtagggtgggggcgggggcgggggggcgcagctgagcgttgctatggtgaagctgtgacatcagaggagaacccgagaggtgaccgagagcgcgagagaggtggtgcaggctggcaggggcaggcatgttcctagatgcgcagggccctgagaggcctggggtggccggcgaggagtggcgagggagtgcatgaggcaaagggcctaaaaataagcccttttcaagaagctcccaggggcagcgcctcaatttgtcatcgctgcacaaacatctctgctgagttcagtgtggacagccaaaccagccacccagcagagaggagaatcaccaccggcgtcatttccgagcagcgactgtgccggcccgccgggcgccgtgcatctactgttgcatgcgatcgctgcggtaacctcgagaggccaatgcgaggctcccggacgaggggctgaagctggcagaggcaagttaccagcccaaggtcaacaagctagctcccagcagagctgcgactggaagcccagtttgagtgtgggagcaccagtgaccagtaaatggagctggttttctcagcaagtggagtcggcgaggctgctggccactagggtgcagcatctgccctgggggaggaagagtctgtggccctttactcctggaagaagccatgtgtgcctggccaaggaagggcttggaaacagaaggcctgtgggaccccaggcacgccaccgaacctctgtgggcctctgtttcaacagaggtgtaattcagcaacaaggatgcagtacagataaaaaaggatagtgcatatgaagtgccggatacagtgccgggcacaaagaaagttatcatggatgcagctattggtttggtgacctcagacccctcatgatagtgggaacaatccccctgaccgcgacacctccttgtaaggattaaacaagctggtggacctgcagtgccttccagaatccctggtcccgttgggcactcaatttcttgtaggaacataaccatggcaatgaactgtgtgaccttaggcagtaacggcccaggctttagctgccttgggtataaaatggggcaatgacatgtgtcgtcttctcactgtgctgtgagagctgagtgcaactgggaaagccaagtgcttggcttggagcctcagataagaaatgagtaagtgacagtcacggtcaccatcaccaccaccaccaccaccaccttcatgatcagcactgtgttagcctggaaactccggggctggccccaggggatgggggacggctgttttactagtcaggcatggcaagcccagggacccctggaagtcaccccactggggtcccactgcgtaccatgctggcgaacagctccccgtcatcgtcgcaggccacccctccggggctgtagagctggaaccagccatctttgccggcccgcacgctcagcaggcatgagtggacctgccagacaagggaagacacaagtgtgagctgcatgcagccccggtgacaagggcgaccatgatctgcacacatgaatgggaaaggctcaggcaagtcctgcagtcaagaaacccgcttaactttgtttcctccagcaacccccagccttccaccaaatgccatgaaaggtctttcgggaaataccgtggcccccacaccccaggggactctggctactggctgtcagctgcacaggagggagggcaggccccggcttgattggctgatctgaatgaagcgggcctgtggctgcagcaggtagagatgcccagagcaaccgcccacaatcagccccttttccctttctcctgccccctttctccttctgctatgccttcctctgggtggggccatctcctgggtctccgttctctgtttggttctctgtcctcctctctctgtgtttctaactcctctcccgtgctctctgccctctttctctagaaacctctccctgctgcctctctggggttctgctgcccccagcactgactctccctcttgggtgtgtgccttctgccctccctttcttgacttgtgcaggcaccatcctcccctccaggtatctgccctgctaatctctctctctctctctctctccccctctttgggactctgccaccctctcttgttaggtctcatccccacttccttccctgagtctttgtccccctccactgaaggatctgtccgtggctgggggcaatttcagtgccaaaagcacagctctcacattccttcccagagctgtgtgtctgtgtggatgggcctgtttgtgcatgtgagcacacgtgtgtgtgtgtatgggaggaattccacatccactctggcccctgctgtgattacacagagagagagggaaggagggagaggatggagagcggggagagtgagggagagagacagagcatgagagcaagggcgtgcaggaaacacaaaggacttttccccacctcctcctgtcctccgaggaaagctgagagaagttcctcatcatttcctttaggaaaggacgattggctgccaagaatctgttacccacagatattaaactgatcacaacccacacgcgagcacacag

SEQ ID NO: 982 - DNA, 3381 bp, Homo sapiens
atatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaac

SEQ ID NO: 983 - DNA, 2781 bp, Homo sapiens
ctctgtcagtggcggctgctgcctactctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggagggtaagacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgagcatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatatataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggagaaatatacctgtataag

SEQ ID NO: 984 - DNA, 3268 bp, Homo sapiens
gctggatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggaattgcttgatagacaaaaggatgttattgatgtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggcttctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttactggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgcctcacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatggttcactgaagtgtatgggttactgtcctcagataaaccctttgtggccagatactacattgcaggaacattttgaaatttatggagctgtcaaaggaatgagtgcaagtgacatgaaagaagtcataagtcgaataacacatggacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtagatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaggcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaatacat

SEQ ID NO: 985 - DNA, 3907 bp, Homo sapiens
gattctgtcgcgaaccctctcacggcagctatgagactgctgcgctccccagacgaggaaacctggtctcccggagccaggtggagtctcgctctgtcgcccaggctggagtgcggtggcgcgatctcggctcactgcaagctccgcctcccgggttcacgccattctcctgcctcagcctcccgagtagctgggactacagagtcttgctctgtcgcccaggctggagtgcagtggcgcgatctcggctcactacaacctctgcctcccaggttcaagtgattctcctgcctcggcctcctgagtagctgggattacagctctgggacaaaccagcttctatgtcatgagcacactcaggcagctcattggagagatctgcatggtaaagcaatgaggcctcctgccagcagccatgtgagtggcatcttggagccagaccctccagccccagtcaagccttcggatgcctgcagccctggctgacattttaaccacaacttcatgagagattctgagccagaatcacccagctaagctgctcccgggttgccagatcaatccacagttctccggggacccattgtggttttgtgcttcctctgtgcctgttctgctcctctccatgcaccccagcccctcccagtcccctcaacggtccttctggccaggcccatagccccctctctgccccacagtcctcaggctccagctttctcgttaggaagtgttagaaagttgctggagtgagaaatgagcctgtgaaactcgttgtcctaattaaacttccacaaggagagtgacaagaggcgacggggaggaaacggtgccaccaccaaggtctcagcctgggcccaggtcgaggaaggcctttgtcctgcagaacaaaagccactgtttgcacgtgttaaacttcatcaaacttcaacagacccaggtgcaaaaccccacatcccaaatgccatccgggcttatgccaccttcccgagcatggaccatccctagccgtcaaccctaatcagggccatgccctacatcaaagctgcactccctccacagacagcttctgctctgagatgcattgttcctatgacttcctacactccgcccttgtctgacgaattagggcacggagcccccccatggcacagctgggccctgctggcattgttaatgaggtaggaagggcgcgtttgtctgagcctgggactaacataatcacataaagttgttgctttggaatagatggagctgccccagagtcgattttcttggaagcaacgcaaagcacagcttcctgggagaagacacaatgcctcctattgtctctgccacttcccctccagcctcccagcatttctgcgtctcctcgggagccactgccctgtgcaagagctgtttgctgatgcccagccgcggcttccaaaactcccgcgagaagtcgtttctgtccacagtcattgtttccagaccagccgagccaactggggaggagaggccaggcccagggagagcagtaagaggcccagcttgcaacacaggcccccggcggctggagtcggctcatgggttgctggggggcagctggtgccagccctgctagacatgtccagggtcggggcagaggccagggtggctctcatccacaacgaggctccaggaagaggctccagagggcccaggtccctggaggaagacagagggtggattatccagtgagtcctcagattgctccagggatactctacccctaggccctcatcctacctaggactgaggcagccatctgggtctctgcttccctaaccacttcctcctccacccgaccatcacctagtctcaaggacttgggcagcttctggaagtggctgagactggaagaatgttgtcacacctaccagatatccctacgtgtatctctaccacccccactacatattctgaagaaccaaggtgagctgggggaatccccaggccagcagggcaaggcctgggcaggaatggagtgaggaagtgagaagtggggatcttgggggtgggcgggctgtggggctgggctgtgctgcgcactgggcaggaggcgggagatggcaatggaagcgacagctccccatcttccccggctgcatacgtgagggattctgctgcattcactgagtcaccaaaggacactggaaggccatcaggatttttgggtgaccaagacatggctcccctcttactgcctgtggggagacaggcatgtgaacacccaagtctaacccaagctgagttgactgagggccatttaaagattccacagaggctgagagcagtggctcatgcctgtaatcccagcactttgggaggccaaggcaggtggatcacttgaggtcaggagctcgagaccagcctggccaacatggtgaaaccccgtctctactaaaaatacaaaaattagccaggcatggtggtgcacaccagtagtcccagctactcaggaggctgaggcaggagaatcgctggaacccaggaggcaaaggttgcagtgagccacgatcacaccacagtactccagcctaggtgacagagcgagactccgtctcgaagataaacaaataaagaaaggttccaaggatggtctggaggacaaacaaaggaggagatttggtgcaggagttaggacaaagactcctgggacagcagccctcacttggggccatagtgaatgaatgggggccttttgcagaagggaaatggaggacatgtgtggtgaaggctttgctgaagcatctcttataaaaggggcaaaagcacttgctctcctcccagctctggctcagcctctctctcttcaagtccctggcatccctggaaaaccatgatttttccattctgcagccagcccaggcacctcctcccacccccgcacactgcagtctggtgtgtgtggtgggcacacatagaacacttgctggtcttgaaaatgaagccatcttttggggcccctagaaatcaaagagacccacttagccaagatatcactcttggacaccagcaagggtgagatcacttgataggtattttgccgtgtgtttctttttaactatataaaaaacaaaagggtggatgtgcaaacccaacccaagaataccttggctcaggctcaactagatgaaacttttaaaaatgatttaatgttatgttagactgttgcatattaaagcgatgtaatgccttctaagaaacgagagtcagatcctgaaagcgatgacttgggtaaatgtaaggagttataactcacttttcaagagagcaactataaacattttgcccaatatgtacagacctctaatgacagtgtgcaaagactttttcgttcccagattatgaggctgccactttctcctccccttcctgagccgcacttttctaaacagcaactgtcggggcagggggatgggaagctcatgagagaaggaaatatttgggaccgtgtcggccagtggaatggggcttgtggtcaccgtgttacagagtcaaatcacttcccagtaaacaccagtttccgatggctctctggccagggttggccggggacaagcagggagtatatgtgtcgggtacgttgcgtcacaagctgtgcagctgtgtaggcctctctgtccagaggcattaatggaaaatgattgggcacccagcccacagcagatgcgctgaggaatccagccagggggagctgggatgcagtgggagaggggacacgcagggcctggctgagaagcctcgcgaggtaaccacaggcggaaatctgaaaaatgaagacgttcccaccagttccagaaaacagggctaacttaaaatgcagcccctttccttgaagtgggcttggcaggccccaggtgttgaaaggcaaaagaaaaaaaag

SEQ ID NO: 986 - DNA, 2539 bp, Homo sapiens
agtgtacgcttgcgcagctccaaggggagggggccgctagaggtgaactccaaggagttatccaggtccggtctgcgggtgctcgccttaatactgctctctgagcgtcagctacttgtattcggggcttaacaccacatggaagctgctggtttacagcttgtgccctctgaagcagtgtcctggacccctttgagccaaggctggagccagagcagccaggatatgaagagcagtgtcctgaggctgtgtagtatagcacagcccagggcttggccctgaaaccattatttcctggtagacctctgggctgtcccaaagacttctgaaatgcctcctagtcttttttttccctcattgtcttggatattagcacttggctcccttttagtaatgctaatctctctagcaagtgattgctctacagtctgcttggattctttctttaccacagggctaagatgcacattttctgaacttatgctctactttccttttaaatataagtaccaacttcgtcatttatttgctcctatatctgataatatgctgttataagcaaccaggctacatcttgaatgctttcctgcttagaaatttcttgtaccagggctgcattgcagccgccacggcgtcgcttggctcctcactcccaacaatggcagctccgagcctgagcggcggctgcggctccgggggcagcagcggcagcctcaccccgggacctgtaggatccctgaagccaggccacccagccatcagcagcatgcagggtaaacgcaaagcactgaagttgaattttgcaaatccacctttcaaatctacagcaaggtttactctgaatcccaatcctacaggagttcaaaacccacacatagagagactgagatcacacagcattgagtcatcaggaaaactgaagatctcccctgaacaacactgggatttcactgcagaggacttgaaagaccttggagaaattggatgaggagtttatggttctgccaacaaaatggtccacaaaccaagtgggcaaataatggcagttaaaagaattcggtcaacagtgaatgaaaaagaacaaaaacaacctcttacggatttggatgaagtaatgcagagtagtgattgcccttacattgttcagttttatgatgcactctacagacagggtgactgttggacctgtatggaactcatgtctatctcgtttgataagttttacaaatatgtgtatagtgtattagatgatgttattccagaagaaattttaggcagaatcactttagcatctgtgaaagcattaaatcacttaaaagaaaacttgaaaattattcacagagatatcaaaccttccaatattcttctggacagaagtgaaaatattaaactctgtgactttggcatcagtgggcagcttgtggactctattgccaagacagaagatgctggctgtaggccatacatggcacctgaaagaatagacccaagtgcatcatgacaagcatatgatgtctgctctgatgtctggagtttggggatcacattgtgtgagttggccacgggctgatttccttatccaaagtggaatagtgtatttgatcaactaacacaagtcgtgaaaggagatcctccgcagctgagtaattctgaggaaaacgaattctccccaagtttcatcaactttgtcaacttgtgccttacgaaggatgaatccaaaagaccacagcataaagagcttctgaaacatctttttattttgatttatgaagaacgtaccattgaagtcgcatgctatgttttgtcaaatcctggatcaaatgccagctactcccagctttcccatgtatgttgtttgatatcgctgctacatcagactaaaaaaaagggctgagaggaagcaaaaggtaaagaattttcatccctatcacagtgtttttattgctcacccagacaccatgtgcaatgacattggtgttcatttccatcatgtctacatattcctgtcacctagaacgtgcatcctggtaatacctgattgatcacacagtgttagtgctggtcagagagacctcatcctgctcttttgtgatgaacatattcatgaaatgtagaagtcagtatgatcaagttgttgactgtgattagatcacatcttatattcatttatagactccaaacctggagatgcagctactggaatggtgttttatcagacttccaaatcctggaaggacacggtgatggatgtactatgtctgaacatagagactcaggcttgagtgagaagagcttgcacagccaacgagacacattgccttctggagctaggagacaaaggaggaatttactttcttcaccaagtgcaatagatttactgatgtgatattctgttgctttacagttacagttgatgtttggggattgatgtgctcagccaaatttcctgtttgacatatcatgttaaattagaatgaatttatctttaccaaaaaccatgttgcgttcaaagaggtgaacattaaaatattgagacagg

SEQ ID NO: 987 - DNA, 3663 bp, Homo sapiens
gtggcactcacggaatctcgggtcttctgacgtgccgggcgggaagatgtcatcattgccaagaagagcgaaagtacaggtccaggatgtggtactgaaagatgaattttcttcattctctgagttatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctgaatagctctgtggctattgctgatactgctttagaagacagaaaaaataaattggatactgtacagactctgaaaacagccaagacaaaacagaaatgtgcagcgcagccacatacagttcgaaggactaaaaagctgaaagttgaagaagaaaccagcaaagccagcaacttagagggtgagagtaatagttcagagacaccatccacaagcactgtgtggggaggtacatgcaagaaggaagagaatgacgatgactttacatttggtcagtccgctttaaagaaaatcaagactgagacatatcctcaggggcagcctgtcaagtttccagcaaatgccaatagtactaaagaggaggtggaaatgaattgggacatggtacaggttttatctgagagaactaatattgaaccttgggtttgtgccaacatcattcgtctctttaatgatgataacacaattcccttcattatacgttatagaaaagagctcattaataaccttgatgctgattccttgagagaagttcagcaaaccctagaagagctacgggctgttgcaaagaaagttcatagtacaatccagaaaattaagaaggaagggaagatgtctgagtgcttgttaaaagccatgctgaattgtaaaacttttgaagaactagaacacgtgtctgctccatataaaactggaagcaaagggactaaagcccagagagcaagacagttgggcttagaaggagcagccagggcactgcttgagaaaccaggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcggccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtctccttgatttgaattgtaccgtctttgttgacacagtagggctgggcagtgtttaatccttccattttatagatttttttttaatcaggccttttggactttattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtg

SEQ ID NO: 988 - DNA, 3979 bp, Homo sapiens
gaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagc

SEQ ID NO: 989 - DNA, 2721 bp, Homo sapiens
gtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtgggtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacg

SEQ ID NO: 990 - DNA, 3256 bp, Homo sapiens
atccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaaggaacactcatgacagtgagatgttgggtctcaggaggctatccagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacgtacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagctgaaaagagtgaagattcctctggtgctgcaggcctctcaggcttacatcgcacatacagccaggactgtagctttaaaaacagcatgtaccatgttggagatcacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttgg

SEQ ID NO: 991 - DNA, 3123 bp, Homo sapiens
attcaagatgagcagtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcgttctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcaattattaaaagagcagaaggaactagaagaattgttgggacatcaggtcgtcctaaaggatgaagtggcccaccatcaaaccattccagtacaaattggaaaagagatagaaaaaataacacgcaaaaaagtagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagggagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagagcttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaattgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaagtacggaaatgg

SEQ ID NO: 992 - DNA, 3384 bp, Homo sapiens
gagggcacgaagaggcaccgaccgtacccgggcgcaccggcaggagagcggcaccgtggctgccgcagcgcgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacgggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcagtcctccgtgatgatttccggcagtctcctggaaacgtggtggtggcagtgggggagccagcagtactggaatgcgtgcccccccgcggccacccggagccttccgtgtcctggaggaaggacggtgcaagactcaaggaagaggaaggaaggatcacgatccgtggagggaagctgatgatgtcacatacactcaagagcgatgcaggcatgtatgtgtgcgtagcctccaacatggcgggagaacgggagagtgcggcagctgaagtcatggtactggagcgtccctcattcctgcgcagaccagtgaatcaggtggtcctggctgatgcccctgtgactttcctatgtgaggtgaagggggatcccccacctcgtctacgctggcgcaaggaggatggggaactgcccacaggcaggtatgagatccggagtgaccacagcctttggattgggcatgtgagtgccgaagatgagggaacgtacacctgtgtggcggagaacagtgtgggccgcgctgaagcatctggctccctcagtgttcacgtcccaccccagttggtgacccagccccaggaccagatggcagctcctggagagagcgtggctttccagtgcgagaccaaaggaaaccccccacctgccatcttctggcagaaggaggggagtcaggtcctgcttttccccagtcagtcacttcagccgacggggcgcttctcagtgtctccaagaggccaacttaacatcaccgcggtgcagcgtggggatgctgggtactacatgtgccaggctgtcagtgtggctggcagcatcctggccaaggccctgctggagataaaaggagcctctttggatgggctgcctcctgtcatcctccagggaccagccaatcagacgctggtgcttggctcctccgtgtggctgccctgcagagtgactgggaaccctcaacccagtgtccgatggaagaaggatgggcagtggctgcagggggatgacctccagttcaagacaatggccaacggtaccctgtacatcgccaatgtgcaggagatggacatgggcttctacagctgcgtggccaagagttccacaggggaagccacatggagcggctggcttaagatgcgggaagactggggagtatcaccagacccccctacagaacccagttcccctccgggggctccctctcagccagtggtcactgagatcaccaagaacagcattaccctgacctggaagcccaacccacaaactggggctgcagtcacgtcttatgtgatagaggccttcagcccagcagctggcaacacatggcgtactgtggcagatggcgtgcagctggagacacacacagtcagcggtctgcagcccaataccatctacctgtttctggttcgagcagtgggagcctggggcctcagtgagcccagccccgtctctgagcctgtccgtacacaggatagcagcccctctaggccagtggaggacccatggagaggccagcagggactggcggaagtggctgtgcgcctgcaggagcccatagtcctgggaccccggaccctgcaggtgtcctggactgtggatggcccagtccagctggtgcaaggtttccgggtgtcttggagggtagcaggccctgagggaggaagctggacaatgttggacctacagtccccaagccagcaaagtactgtgctaagaggactccctccagggacccaaatccagatcaaggtgcaagcccaaggccaggaggggctgggggctgaaagcctctctgtgaccaggagcattcctgaggaggcccccagtggccccccacagggagtggcggtggccttggggggtgatggcaacagcagtatcactgtgtcctgggaacctccactcccctcccagcaaaatggggtcatcacggaataccagatctggtgcctgggcaatgagagccgctttcacctcaatcgatctgcagcaggctgggcacgctccgcaatgctccgaggactggtgcccggtctcctctatcgaaccctggtcgcggcggccaccagcgcaggcgtgggcgtgcccagtgccccagtgctggtgcagctgccgtccccgctggacctggagcccgggctggaggtgggcgcggggctggcggtgcggctggcgagggtgctgcgggagcccgccttcctcgcgggcagcggcgcagcctgcggggcgctgcttctcgggctctgcgccgccctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcaggaatctccctgtatctagctcagacggccaggggcacggccgcccctggcgagggtcctgtctatagcaccattgaccccctaacaacccccctcctaatactaactacctgactcctacccctcacaatcatggcaagccaacgccacttatccagtgaaccactatcacgaaaaaaactctacctctctatactaatctccctacaaatctccttaattat

(The sequence listing continues in the following parts.)

What is claimed is:

1. An isolated polynucleotide consisting of a protein-coding region of the nucleotide sequence of SEQ ID NO 1637; or a polynucleotide encoding a polypeptide comprising the amino acid sequence of SEQ ID NO: 3276.

2. A vector comprising the polynucleotide of claim 1, wherein the expression of the polynucleotide is regulated by an exogenous promoter.

3. A transformed host cell carrying the polynucleotide of claim 1 or the vector of claim 2.

4. A transformed host cell carrying the polynucleotide of claim 1 or the vector of claim 2 in an expressible manner.

5. A method for producing a polypeptide or a peptide, said method comprising the steps of culturing the transformant of claim 4 and recovering an expression product.

6. An antisense polynucleotide of the polynucleotide of claim 1 or a part thereof, wherein the length of the antisense polynucleotide is 15 to 2382 nucleotides.

7. A method for synthesizing the polynucleotide of claim 1 comprising steps of:

(a) annealing an oligonucleotide to a template polynucleotide comprising the nucleotide sequence of SEQ ID NO: 1637, wherein the oligonucleotide comprise a nucleotide sequence complementary to the nucleotide sequence of SEQ ID NO: 1637 or to a complementary strand thereof, and comprises at least 15 nucleotides, (b) synthesizing a complementary strand of the template and (c) recovering the synthesized product.

* * * * *